United States Patent 7,171,311 (METHODS OF ASSIGNING TREATMENT TO BREAST CANCER PATIENTS) - sequence listing, part 2

SEQ ID NO: 988 - DNA, 7515 bp, Homo sapiens
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcacgaggagcagcaggtgcccatcctggagaagttttgcttcactccccacacggaggaggggtgcctgtctgagcacgctgccctcgaggaggagctgcaactgtgcaaggggctggtcgaggcactcgagaccaaggtgacccagcaggggctgaagatggtggtgccggactggacggggcccagatccccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggccggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgcggacctcctggtgtgcaactgtgctgtggctgccctcggggacccggcctcagctctcagcaacatggtggctgccctgagagaagggggctttctgctcctgcacacactgctccgggggcaccctcgggacatcgtggccttcctcacctccactgagccgcagtatggccagggcatcctgagccaggacgcgtgggagagcctcttctccagggtgtcgctgcgcctggtgggcctgaagaagtccttctacggcgccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcggaaccgtccggtgtgtgctgctctccaacctcagcagcacctcccacgtcccggaggtggacccgggctccgcagaactgcagaaggtgttgcagggagacctggtgatgaacgtctaccgcgacggggcctggggggttttccgccacttcctgctggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttcggtacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtcgaggccgccatccgggatggggtggtacggcccctcaagtgcacggtgttccatggggcccaggtggaggacgccttccgctacatggcccaagggaagcacattggcaaagtcgtcgtgcaggtgcttgcggaggagccggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccaggggctacaggtgcaggtgtccaccagcaacatcagctcactggagggggcccggggcctcattgccgaggcggcgcagcttgggcccgtggggggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcaccgtgggcattttggtggagacgatgagcaccaacgacacgatcgtcagtggcacgctgcccacgcgcattggcgtccttggcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctgggcggctcactggcggacctgggcctggactcgctcatgagcgcgccggtgcgccagacgctggagcgtgagctcaacctggtgctgtccgtgcgcgaggtgcggcaactcacgctccggaaactgcaggagctgtcctcaaaggcggatgaagccagcgagctggcatgccccacgcccaaggaggatggtctggcccagcagcagactcagctgaacctgcgctccctgctggtgaaaccggagggccccaccctgatgcggctcaactccgtgcagagctcggagcggcccctgttcctggtgcacccaatcgaggctaccaccgtgttccacagcctcggtcccggtctcagcatccccacctatggcctgcagtgcaccccggctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtaaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaggctgcgtgccgctgaccagtatacacccaaggccaagtacagtggcaacgtgatgctactgcgggccaagacgggtggccgctacggcgaggacctgggcgcggactacaacctctcccaggtatgcgacgggaaagtatccgtccatatcatcgagggtgaccaccgcacgctgctggagggcagcggcctggagtccatcatcagcatcatccacagctccctggctgagccacgtgtgagtcgggagggctag

SEQ ID NO: 989 - DNA, 1468 bp, Homo sapiens
gccactccagccccgcgcccctcgccgcggccctcgggcgtctgcgccgcagctgccgcccccgcctctttggagtctctcgcggcctcaaagcgcggcctgcgtcgcttccggcagttccagaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcagctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagtagtagttaaatctgaatgtgtatggactaaaaatatttaattgctgagtaaactgcttaacttcaaagatagttattgaccttataaataaatatttcaaaattttgattcggaagactaagtctggagctagacattataatgctatcaaagaagttgatctctgttttgactaaactagaggaaaaatgattggatgagtttattcttttctaagcagaatggtttaactttgtactcaaagaaaaataatgctgatttataaatctctgcctataatagaatgg

SEQ ID NO: 990 - DNA, 1838 bp, Homo sapiens
atccacttgcaggttgctgctcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggaggccctccttttgtgccagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaccc

SEQ ID NO: 991 - DNA, 2107 bp, Homo sapiens
agtaaaagtccacagttaccgtgagagaaaaaaagaggagaaagcagtgcagccaaactcggaagaaaagagaggaggaaaaggactcgactttcacattggaacaaccttctttccagtgctaaggctctctgatctggggaacaacacctggacatggctccagagatcaacttgccgggcccaatgagcctcattgataacactaaagggcagctggtggtgaatccagaagctctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagccagaacacaccctagttctgctcgacactgagggcctgggagatatagagaagggtgacaatgagaatgactcctggatctttgccttggccatcctcctgagcagcaccttcgtgtacaatagcatgggaaccatcaaccagcaggccatggaccaacttcactatgtgacagagctgacagatcgaatcaaggcaaactcctcacctggtaacaattctgtagacgactcagctgactttgtgagcttttttccagcatttgtgtggactctcagagatttcaccctggaactggaagtagatggagaacccatcactgctgatgactacttggagctttcgctaaagctaagaaaaggtactgataagaaaagtaaaagctttaatgatcctcggttgtgcatccgaaagttcttccccaagaggaagtgcttcgtcttcgattggcccgctcctaagaagtaccttgctcacctagagcagctaaaggaggaagagctgaaccctgatttcatagaacaagttgcagaattttgttcctacatcctcagccattccaatgtcaagactctttcaggtggcattgcagtcaatgggcctcgtctagagagcctggtgctgacctacgtcaatgccatcagcagtggggatctaccctgcatggagaacgcagtcctggccttggcccagatagagaactcagccgcagtggaaaaggctattgcccactatgaacagcagatgggccagaaggtgcagctgcccacggaaaccctccaggagctgctggacctgcacagggacagtgagagagaggccattgaagtcttcatgaagaactctttcaaggatgtggaccaaatgttccagaggaaattaggggcccagttggaagcaaggcgagatgacttttgtaagcagaattccaaagcatcatcagattgttgcatggctttacttcaggatatatttggccctttagaagaagatgtcaagcagggaacattttctaaaccaggaggttaccgtctctttactcagaagctgcaggagctgaagaataagtactaccaggtgccaaggaaggggatacaggccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggaggaaatacaaaagaagaatgaggagatgatggaacagaaagagaagagttatcaggaacatgtgaaacaattgactgagaagatggagagggacagggcccagttaatggcagagcaagagaagaccctcgctcttaaacttcaggaacaggaacgccttctcaaggagggattcgagaatgagagcaagagacttcaaaaagacatatgggatatccagatgagaagcaaatcattggagccaatatgtaacatactctaaaagtccaaggagcaaaatttgcctgtccagctccctctccccaagaaacaacatgaatgagcaacttcagagtgtcaaacaactgccattaaacttaactcaaaatcatgatgcatgcatttttgttgaaccataaagtttgcaaagtaaaggttaagtatgaggtcaatgtttt

SEQ ID NO: 992 - DNA, 960 bp, Homo sapiens
agcagctccaaccagggcagccttcctgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacaagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctctcccagtgtaaatctggagccaagtccagatttacactgggagaggtgccagcaactgaataaatacctcttagctgagtgg

SEQ ID NO: 993 - DNA, 853 bp, Homo sapiens
agtggcaccgctgactgccgagaggaagctcgcctctgcccggctgccctcttgtagtccgccggcgaggggcagttctcggtgaggaggaagagagcagcggacggcacagcacccgcgcgggccctcccacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagag

SEQ ID NO: 994 - DNA, 1832 bp, Homo sapiens
aaggacagaggaggggcccttcctgtcagctggctgggagcagaggtggctttgtcttttcggaagaactggttctgtggaatttgtgcttatttcccatcaaggatcaaggacctgctctggggctacctcagggccccacaggatgaggggctggttttcagatgagttttctgcttgcctgtcatctggatagtgtctaaaaatttgcaaactgccttcttgtcagtgtcttgctcattcttcatgacactcctgatatgtctctcagtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtcaaaa

SEQ ID NO: 995 - DNA, 1042 bp, Homo sapiens
ggcttgggaaggggaaggaaacttctctgaaatctgaacacctgctctcccggcaaggaaacttcgaaggctgaccgaccaagaccatcactatgaccgatggagactatgattatctgatcaaactcctggccctcggggattcaggggtggggaagacaacatttctttatagatacacagataataaattcaatcccaaattcatcactacagtaggaatagactttcgggaaaaacgtgtggtttataatgcacaaggaccgaatggatcttcagggaaagcatttaaagtgcatcttcagctttgggacactgcgggacaagagcggttccggagtctcaccactgcatttttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggcataccatattttgaaacaagtgcagcaactggacagaatgtggagaaagctgtagaaacccttttggacttaatcatgaagcgaatggaacagtgtgtggagaagacacaaatccctgatactgtcaatggtggaaattctggaaacttggatggggaaaagccaccagagaagaaatgtatctgctagactctacatagaaactgaacatcaagaaccccaccaaaatattacttttaaaacaatgacaaaccacacaattgttgttgagtaaaccacgcacaatggcatgtctttctttttctgccagaaaatctattttaagaaaccagaatagtcaacagtgttcaaaagaattgactagttatccctgaggccctttcaaacatgatcaaagatttcccaatgtgatctcatcatcatggatactcaatttgttttttcttatagagaaaatgagtatatagacatatacagagaat

SEQ ID NO: 996 - DNA, 1674 bp, Homo sapiens
atagcggcgacagccatggggaaaccggcgaggaaaggatgcccgagttggaagcgcttcctgaagaataactgggtgttgctgtccaccgtggccgcggtggtgctaggcattaccacaggagtcttggttcgagaacacagcaacctctcaactctagagaaattctactttgcttttcctggagaaattctaatgcggatgctgaaactcatcattttgccattaattatatccagcatgattacaggtgttgctgcactggattccaacgtatccggaaaaattggtctgcgcgctgtcgtgtattatttctgtaccactctcattgctgttattctaggtattgtgctggtggtgagcatcaagcctggtgtcacccagaaagtgggtgaaattgcgaggacaggcagcacccctgaagtcagtacggtggatgccatgttagatctcatcaggaatatgttccctgagaatcttgtccaggcctgttttcagcagtacaaaactaagcgtgaagaagtgaagcctcccagcgatccagagatgaacatgacagaagagtccttcacagctgtcatgacaactgcaatttccaagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtgttatatgccactaggtattttgttcctgattgctgggaagatcatagaagttgaagactgggaaatattccgcaagctgggcctttacatggccacagtcctgactgggcttgcaatccactccattgtaattctcccgctgatatatttcatagtcgtacgaaagaaccctttccgatttgccatgggaatggcccaggctctcctgacagctctcatgatctcttccagttcagcaacactgcctgtcaccttccgctgtgctgaagaaaataaccaggtggacaagaggatcactcgattcgtgttacccgttggtgcaacaatcaacatggatgggaccgcgctctatgaagcagtggcagcggtgtttattgcacagttgaatgacctggacttgggcattgggcagatcatcaccatcagtatcacggccacatctgccagcatcggagctgctggcgtgccccaggctggcctggtgaccatggtgattgtgctgagtgccgtgggcctgcccgccgaggatgtcaccctgatcattgctgtcgactggctcctggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttctagggcccctggctgcagatgactggaaacaaggaaggacatttcgtgagagtcatctcaaacacggcttaaggaaaagagaaa

SEQ ID NO: 997 - DNA, 3871 bp, Homo sapiens
gcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaattcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtagtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacatt

SEQ ID NO: 998 - DNA, 4154 bp, Homo sapiens
taacgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcgccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttata

SEQ ID NO: 999 - DNA, 1559 bp, Homo sapiens
gtttgagcagcattgttagagcctgtggaaaacactttacaactgtgtaactgtcttcatctttacagaggaatagtctacaaggaagacttgtaacctggagaagagacctgtcatttactacatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccctaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttattggaaaatctagtttcacagctatttg

SEQ ID NO: 1000 - DNA, 1014 bp, Homo sapiens
gcagaaatagcctagggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtgtgcagagaattcaccgagcgtgagcaaggagaagtccgcttctctgccgtggctctctgcaaggcagcctaatgctctgtgggagggactttgctgatttcccctcttcccttcaacatgaaaatatataccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggttatgttgtcctaaagaataaattttgctgatagtagc

SEQ ID NO: 1001 - DNA, 2693 bp, Homo sapiens
cgaaaaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatggcgatgctgttgagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgacccaaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagccttcggctggaagtccatgggccaccctgttcttgtccatggaggacttccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtcctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctaaaaaa

SEQ ID NO: 1002 - DNA, 1881 bp, Homo sapiens
gatatcgaattccggaattccccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagctgcgccagggctacctgccccctgagttcactgccggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggccttcactctcccctgaggctgtcctggcccggactgtggggagcacctccaccccccggagcaggtgcacacccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcggaattcc

SEQ ID NO: 1003 - DNA, 1982 bp, Homo sapiens
ggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttctcgtgccgaattcaaaaagctt

SEQ ID NO: 1004 - DNA, 1224 bp, Homo sapiens
ggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgt

SEQ ID NO: 1005 - DNA, 728 bp, Homo sapiens
gcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattcttcaacagaaaaaaaaaaaaaaaaa

SEQ ID NO: 1006 - DNA, 958 bp, Homo sapiens
tctaaagctcagtggagctgggtcatctcaggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtracaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcagggagataccatg

SEQ ID NO: 1007 - DNA, 2304 bp, Homo sapiens
cacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattatttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcatttattgctgagttatatgttcactgtccccctaatattagggagtaaaacggataccaagttgatttagtgtttttacctctgtcttggctttcatgttattaaacgtatgcatgtgaagaagggtgtttttctgttttatattcaactcataagactttgggataggaaaaatgagtaatggttactaggcttaatacctgggtgattacataatctgtacaacgaacccccatgatgtaagtttacctatgtaacaaacctgcacttatacccatgaacttaaaatgaaagttaaaaataaaaaacatatacaaataaaaaaaa

SEQ ID NO: 1008 - DNA, 3703 bp, Homo sapiens
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacctgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttaaa

SEQ ID NO: 1009 - DNA, 2000 bp, Homo sapiens
cttggcacgagggattggtctgtgctcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtcccctgcctgtgcccttcaccaatggggagatacagaaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttatcctgaaccttggcagacacgtcttgttttcatttgattttgttaagagtgcagtattgcagagtctagaggaatttttgtttccttgattaacatgattttcctggttgttaatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaaccaaaaaaaaaaaaaaaa

SEQ ID NO: 1010 - DNA, 3149 bp, Homo sapiens
agggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccagggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctc

SEQ ID NO: 1011 - DNA, 2393 bp, Homo sapiens
cgaggaacgagtgacagccggacagtccgccgggcggtgatccggggccgctcccgggcgcgccctcggctccaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagcgcagccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcaagctgggggcgcccagggccgcctccggccgggccgccccgtgctcatgcccgtttggacctccgcactccttaccgccctcccgctgccgccgtcggggcgatactctgcagccgcggcagggatggcgggggttgcggcccctccaggcaatggcactcggggcaccggagggcgtcggggacaagcggcactggatgtacgtgttcaccacgtggcgctctggctcgtcgttcttcggcgagctattcaaccagaatcccgaggtgttctttctctacgagccagtgtggcatgtatggcaaaaactgtatccgggggacgccgtttccctgcagggggcagcgcgggacatgctgagcgctctttaccgctgcgacctctctgtcttccagttgtatagccccgcgggcagcggggggcgcaacctcaccacgctgggcatcttcggcgcagccaccaacaaggtggtgtgctcgtcaccactctgccccgcctaccgcaaggaggtcgtggggttggtggacgaccgcgtgtgcaagaagtgcccgccacagcgcctggcgcgtttcgaggaggagtgccgcaagtaccgcacactagtcataaagggtgtgcgcgtcttcgacgtggcggtcttggcgccactgctgcgagacccggccctggacctcaaggtcatccacttggtgcgtgatccccgcgcggtggcgagttcacggatccgctcgcgccacggcctcatccgtgagagcctacaggtggtgcgcagccgagacccgcgagctcaccgcatgcccttcttggaggccgcgggccacaagcttggcgccaagaaggagggcgtgggcggccccgcagactaccacgctctgggcgctatggaggtcatctgcaatagtatggctaagacgctgcagacagccctgcagccccctgactggctgcagggccactacctggtggtgcggtacgaggacctggtgggagaccccgtcaagacactacggagagtgtacgattttgtgggactgttggtgagccccgaaatggagcagtttgccctgaacatgaccagtggctcgggctcctcctccaagcctttcgtggtatctgcacgcaatgccacgcaggccgccaatgcctggcggaccgccctcaccttccagcagatcaaacaggtggaggagttttgctaccagcccatggccgtcctgggctatgagcgggtcaacagccctgaggaggtcaaagacctcagcaagaccctgcttcggaagccccgtctctaaaaggggttcccaggagacctgattccctgtggtgatacctataaagaggatcgtagtgtgtttaaataaacacagtccagactcaaacggaggaagcccacatattctattatagatatataaataatcacacacacacttgctgtcaatgttttgagtcagtgcatttcaaggaacagccacaaaatacacacccctaagaaaaggcaagacttgaacgttctgaccaggtgcccctcttcttctttgccttctcttgtcctctttctcctatttcttaccctgtcctccacctgccttccattttgaagtgggatgttaatgaaatcaagttccagtaacccaaatcttgtttacaaaatattcgtggtatctgtgaacatgttaagagtaatttggatgtgggggtgggggtggagaaaggggaagtggtccagaaacaaaaagccccattgggcatgataagccgaggaggcattcttcctaaaagtagacttttgtgtaaaaagcaaaggttacatgtgagtattaataaagaagataataaat

SEQ ID NO: 1012 - DNA, 2605 bp, Homo sapiens
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtgcaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaaaaaaaaaaaaaaaaaaaaaaaaaaaaaaaaaaaaaaa

SEQ ID NO: 1013 - DNA, 2174 bp, Homo sapiens
gccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatcagaaaccattgaaactgcttcaagaattgtatctttaagtactgctacttgaataactcagttaacgctgttttgaagcttacatggacaaatgtttaggacttcaagatcacacttgtgggcaatctgggggagccacaacttttcatgaagtgcattgtatacaaaattcatagttatgtccaaagaataggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttct

SEQ ID NO: 1014 - DNA, 1999 bp, Homo sapiens
gccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcgggggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttatt

SEQ ID NO: 1015 - DNA, 4200 bp, Homo sapiens
gactctcgcctgacttcctaatttgctacttatccccagcgttggtcccggcgaggatatgctgagatttatggcactgttggctgcatttttggagaacagcaagcagcttcttttcagataatcccaccgtttctggcatgtcagatatggattatcctttacaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattgcctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccag

SEQ ID NO: 1016 - DNA, 1842 bp, Homo sapiens
ccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttatgcatatttcaatttccacttaaatttatttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgcttttattgactagtaaaagttactgcctagtctttttaccttaggcttacagaattaaataaaaattagccattccagaaatataaaaaaaaaaaaaaaaaaaa

SEQ ID NO: 1017 - DNA, 1921 bp, Homo sapiens
ccccgcgcgagagcggcccttgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagaaagaaaagtaaactgttttcgcggctgcgcagaaagaagaacagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagtttaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatacttaactgaagcttcggccgcaccacccggggaagggtcctcttttcctggcagctgctgtgggtggggcccagacaccagcctagcctgctctgccccgcagacggtctgtgtgctgtttgaaaataaatcttagtgttcaaaacaaaatgaaacaaaaaaaaaaatgataaaaactctcaaaaaaacaaggaattc

SEQ ID NO: 1018 - DNA, 900 bp, Homo sapiens
gggactcggcggaggatgggcttgctctcaattttgcgcaagttgaaaagtgcaccagaccaggaggtgagaatacttctcctgggcttggataatgctggcaagaccactcttctgaagcagcttgcatctgaagacatcagccacatcacacctacacagggtttcaacatcaaaagtgtacaatcacaaggttttaaactgaatgtatgggacattggtggacagaggaaaatcagaccatactggaagaattattttgaaaataccgatattcttatatatgtaatcgacagtgcagacagaaaaagatttgaagagacgggtcaggaactagcggaattactggaggaagaaaaactaagttgtgtgccagtgctcatctttgctaataagcaggatttgctcacagcagcccctgcctctgaaattgcagaaggactgaacctgcataccatccgcgaccgagtctggcagatccagtcttgctcagctctcacaggagagggcgttcaggatggcatgaactgggtctgcaaaaatgtcaatgcaaagaagaaataaaatctagacgaatggagatgcaggagctgcgggagccgaattcgggccttaaaaacactaatttgctgctttctgaccaaatgtttttcatctgtgtacactccagctgtttgaagagagggaacaacacggtttagaaagaatccccattccagcagtagatttaactgatctctgaggttcagtatcatttttcaaataaaggaattatattatttcctctgcataattgaaatagtattaaatgtctaaagcacatgattagaaaatgagatcttttaaatgagcaagagattgcattgcagtttagacaattccagtgggctttttttttcg

SEQ ID NO: 1019 - DNA, 2333 bp, Homo sapiens
ggcacgaggctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatctttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatattattttattacatatcattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattgatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcagcagtcatgcacgctgataaaaaaaaaaaaaaaaaa

SEQ ID NO: 1020 - DNA, 1311 bp, Homo sapiens
tagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctcggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggatcggaatttacctgatttcttcagggctgctgggggcaactggccatttgccaattttcctactctcacactggttctcaatgaaaaatagtgtctttgtgatttgagtaaagctcctattctgtttttcacaaaaaaaaaaaaa

SEQ ID NO: 1021 - DNA, 2382 bp, Homo sapiens
agtaccgctgcggccgggggattgggccggggtctccaccgccgaccgaggggagcggcgtccgctcggccctgctttttgcgacctgccgtcagccccacgtcgccggcctggaggggcgaagaggacgaggggcgcaaggcttcctccggggacattggctccctggattatcaagcagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtatttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttcaatgtgtacctgtcttatggaagaaatatgcaggtatataagaccacgattttctaagctgccatataagaatttttgtttttgtaaatggttaaatacatttcctgggtaacttaggaaattaagctttttcataaggcaacagatggtaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagcagggtcggaattacgggtttgtatatatgtatatactcgtttgtatatatgtatatactgggacattttatcttctggcccaaagtcagaactttataaaaatcttgagtttgttcacttaatgtgaaataagctatgtgtccagggtattgctcccctgagtgtatatgagtgctgagtagtattgcagagaatgtgatgagttatcactgtcacaactttttctatagaaaacaggggctgcttttaaactctcactatgggacactttaccaaaatacttccatatcaattatttgaacccggtagtttgtttgacctagttagattgtggtgtttattcaagtttgaaatcatgtttgacaatactgtaaattaggttaattttgaagtcttagcatcatcatattgtgctgttttggataacacgtttgttcaagaacatttaaactgtttctttggtgtcctttacattgaaataaattgtgtttgtgcctcc

SEQ ID NO: 1022 - DNA, 3446 bp, Homo sapiens
ttctagtttgcggttcaggtttgccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaaaaaaaaa

SEQ ID NO: 1023 - DNA, 8093 bp, Homo sapiens
ctcagctccctgtggtgggggatggcagaggcttcccgctccccgcagctggtttgcacagcctcccgactgtgccgtggtgtctccttccctaaagtgggacagtcgtttctgtgtcctgctggcctctgaggaacagacgtgtgtgagaggccttcagggcctgatggctggggtggtgacagtgcctggagaatgggtggggactggaggggccaggtggctaaccactctcctcttccatggcagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaactttcgtgtgggagtggtgtgggtggtggttttcttatgctttggaagcccctagaaataatgacggaagaatgccatgttgctgatcgtggtaataagccattgtgggttattgtatgtcactagtattagcatagcattcttaaaggaatgcagtgttcaaaacctacccaaattccccgcaggattttaccaaacccttccccaggccagttttgtactgaaggcaagaactggacagtcagagaacagtggagggggcaagtgactgaagagcaccgggtaaaaagcacaacatgcagttaaaatgcaaactagaaaactaattttaaatattgttagttttaatatttcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacagggggccatcctctatcttccatccagcggctcttccttttaggaaggctctggtgcagagcacttcaaatatgtcctcaggccagatactgattgctagtagagagacacccggcacccagtccgaagccctccctcaaaggaccggcttatggcgttggtcactggcaggctcagagacattctactgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcaygaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacmcaaaaagcaaactcggttttgccatcagttagaaattacgttttggattgtatattgttacatctctcttccagcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggagacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatac

SEQ ID NO: 1024 - DNA, 3809 bp, Homo sapiens
gccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacggtcccaggcccagagaagatgagtctatggcatcaggttcttaaaccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagcgcagctcagctgcactgcgttccgaggtgaagtcttgcccctgaattttgcaaaatgggaaagtgggcgcttgccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgta

SEQ ID NO: 1025 - DNA, 2044 bp, Homo sapiens
ccggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacagggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttgtgttaaggcagaaataattaggctagggctcttagttttcattcctattgccccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatccgcattttcttatattaaaaaatgttctgcatgattacattttatttgcctttgt

SEQ ID NO: 1026 - DNA, 3090 bp, Homo sapiens
agaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacacctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaaaaaaaaaaaaaaaaaa

SEQ ID NO: 1027 - DNA, 4778 bp, Homo sapiens
gcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgcctttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaattttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgtt

SEQ ID NO: 1028 - DNA, 2710 bp, Homo sapiens
cgccggcgggactggtctgaagagacgcggggacaaagtggcaacgacttggacatctgagctgtcactgccgaaaacaggccgcaagagagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagaggatgtttggcattgtaaaaatcagcatgccagacctgaactttaatcagtctgcacatcctgtttctaatatctagcaacattatattctttcagacatttattttagtccttcatttccgaggaaaaagaagcaactttgaagttacctcatctttgaatttagaataaaagtggcacattacatatcggatctaagagattaataccattagaagttacacagttttagttgtttggagatagttttggtttgtacagaacaaaataatatgtagcagcttcattgctattggaaaaatcagttattggaatttccacttaaatggctatacaacaatataactggtagttctataataaaaatgagcatatgttctgttgtgaagagctaaatgcaataaagtttctgtatggttgtttgattctatcaacaattgaaagtgttgtatatgacccacatttacctagtttgtgtcaaattatagttacagtgagttgtttgcttaaattatagattcctttaaggacatgccttgttcataaaatcactggattatattgcagcatattttacatttgaatacaaggataatgggttttatcaaaacaaaatgatgtacagattttttttcaagtttttatagttgctttatgccagagtggtttaccccattcacaaaatttcttatgcatacattgctattgaaaataaaatttaaatattttttcatcctgaaaaaaaa

SEQ ID NO: 1029 - DNA, 422 bp, Homo sapiens
gggggggggggggtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgccacatgaatatgtgggctaagaatagttcctcttgataaataaacaattaaca

SEQ ID NO: 1030 - DNA, 735 bp, Homo sapiens
gagtctgcccttgcgagctcagagtgtgcccgtgcgccgccgccgtcgtacctgccgccgccgccaccgccaccatgcccaacttcgccggcacctggaagatgcgcagcagcgagaatttcgacgagctgctgaaggcactgggtgtgaacgccatgctgaggaaagtggccgtagcggctgcgtccaagccgcacgtggagatccgccaggacggggatcagttctacatcaagacatccaccaccgtgcgcaccactgagatcaacttcaaggtcggagaaggctttgaggaggagaccgtggacggacgcaagtgcaggagtttagccacttgggagaatgagaacaagatccactgcacccaaactcttcttgaaggggacggccccaaaacctactggacccgtgagctggccaacgatgaacttatcctgacgtttggcgccgatgacgtggtctgcaccagaatttatgtccgggaatgaaggcagctggcttgctcctactttcaggaagggatgcaggtccccgaggaatatgtcatagttctgagctgccagtggaccgcccttttcccctaccaatattaggtgatcccgttttccccatgacaatgttgtagtgtcccccacccccacccccctggccttggtgcctcttgtatccctagtgctgcatagcccggcatttgcacggtttcgaagtcattaaactggttagacgtgtctcaaa

SEQ ID NO: 1031 - DNA, 2510 bp, Homo sapiens
gcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcggactggaacttccttttatgatgatgccccaccctctaattcctgtcagcctacctccagcatctgtcaccatggcaatgagccagatgaaccacctcagcaccattgcaaatatggcagcagcagcacaagttcagagtcccccatccagagttgagacatcagttattaaggagcgtgttcctgatagcccctcacctgccccctctctggaggaggggagaaggcctggcagtcacccatcatcacatcgcagcagcagcgtgtccagctcccctgctcggactgagagctcttccgacagaatcccggtccatcagaatgggttgtccatgaaccagatgctgatgggcttatcaccaaatgtacttcctgggcccaaagagggagatttggccggtcatgacatgggacatgagtcaaaaaggatgcatattgaaaaagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggtttttttttcttaaaaaaaaaaaaaaaaaa

SEQ ID NO: 1032 - DNA, 2553 bp, Homo sapiens
cgggaggcggcggcggcgactccctctttccctccctcctcctccgtccgcccgtccgtccgcgcgtctgtccgttcggcccggtccggcccgaagcatggccggcgtcagcttcagcggccaccgcctggagctgctggcggcttacgaggaggtgatccgagaggagagcgcggccgactgggctctgtacacatatgaagatggctccgatgacctcaagcttgcagcatcaggagaagggggcttgcaggagctttcgggacactttgagaaccagaaggtgatgtacggcttctgcagtgtcaaggactcccaagctgctctgccaaaatacgtgctcatcaactgggtgggcgaagatgtgcctgatgcccgcaagtgcgcttgtgccagccacgtggctaaggtggcagagttcttccagggtgtcgacgtgatcgtgaacgccagcagcgtggaagacatagacgcgggtgccatcgggcagcggctctctaacgggctggcgcgactctccagccctgtgctgcaccgactgcggctgcgagaggatgagaacgcagagcccgtgggcaccacctaccagaagacggatgcagctgtggaaatgaagcggattaaccgagagcagttctgggagcaggccaagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggaggaaacagcagactttagaagcggaagaggccaagaggcggttgaaggagcagtctatctttggtgaccatcgggatgaggaggaagagacccacatgaagaagtcagagtcggaggtggaggaggcagcagctattattgcccagcggcctgacaacccaagggagttcttcaagcagcaggaaagagtcgcatcggcctctgcgggcagctgtgatgtaccctcgcccttcaaccatcgaccaggcagccacctggacagccaccggaggatggcgcccactcccatccccacgcggagcccgtctgactccagcaccgcctccacccctgtcgctgagcagatagagcgggccctggatgaggtcacctcctcgcagcctccaccactgccaccgccacccccaccagcccaagagacccaggagcccagccccatcctagacagtgaggagaccagagcagcagcccctcaggcctgggccggccccatggaggagccccctcaggcacaggcgcctccccgggggccaggcagccctgcagaggacttgatgttcatggagtctgcagagcaggctgtcctggctgctcccgtggagcctgccacagctgacgccacggaggtccacgatgcagctgacaccattgaaactgacactgccactgctgacaccactgttgccaacaacgtaccccccgccgccaccagcctcattgacctatggcctggcaacggggaaggggcctccacactccagggtgagcccagggcccccacgccaccctcgggtactgaggtcaccctggcagaggtgcccctgctggatgaggtggctccggagccactgctgccagcaggcgaaggctgtgccacccttctcaactttgatgagctgcctgagccgccagccaccttctgtgacccagaggaagtggaaggggagcccctggctgccccccagaccccaactctgccctcagcccttgaggagctggagcaagagcaggagccggagccccacctgctaaccaatggcgagaccacccagaaggaggggacccaggccagtgaggggtacttcagtcaatcacaggaggaggagtttgcccaatcggaagagctctgtgccaaggctccgcctcctgtgttctacaacaagcctccagagatcgacatcacatgctgggatgcagacccagttccagaagaggaggagggcttcgagggtggtgattagcggtggcgccagccctaggctacccttgccaaggccgcccacctgcatcagcctctgccagacggcccgccgtgcctgcattcgcagcagctccgcctggcacccactccggattccggccctggctggggacttggccgcttccctacccacagggcctgacttttacagcttttctcttttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctgg

SEQ ID NO: 1033 - DNA, 2173 bp, Homo sapiens
gaactatagttgaaggctgctgccaatacaacaccactgtgaaacagaatggtgtatgccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatactttttttaactgcattctataataaatgggcacagtatgctccttacaaaaaaaaaaaaaaa

SEQ ID NO: 1034 - DNA, 1702 bp, Homo sapiens
ggagtcgaccgctcgggcagcgcaccgccacgagagcccgggacgcgggaaagaccgaaaggaagaggaagaggcaccggtggccatggggctggaggcggcgcgcgagctggagtgcgcggcgctgggcacgctgctgcgggatccgcgggaggcggaacgcacgctgctgctggactgccgccccttcctggccttctgccggcgccacgtgcgcgccgcgcggccagtgccttggaacgcgctgctgcggcgccgcgcgcgcggccctcctgccgccgttctcgcctgcctgctgcccgaccgcgcgctgcggacgcgcctggtccgcggggagctggcgcgggccgtggtgctggacgagggcagtgcctcggtggcggagctccggcccgacagcccggctcatgtgctgctggccgcgctgctgcacgagacccgcgcggggcccactgccgtgtacttcctgcgaggaggcttcgacggcttccagggctgctgtcccgatctgtgctctgaggcccccgcccctgcgctgccgccaacaggggacaaaaccagccgctccgactccagggctcctgtctacgaccagggtggccctgtggagatcttgccctacctgttcctgggcagctgcagtcactcgtcagacctgcaggggctgcaggcctgtggcatcacagccgtcctcaacgtgtccgccagctgccccaaccactttgagggccttttccgctacaagagtatccctgtggaggacaaccagatggtggagatcagtgcctggttccaggaggccataggcttcattgactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctccggcagggctgctacctcctcagagtttcagaagcccccacatgggggctctaggaatgccggcatgctggtctttccgacctggtgctcttctgctgggggactgaggctggccctcattcggggtcgggaaccaagggtgtgtctgctctttccctccccatcctctggcagaaatcagctagacgctataccgtggactctccctggtccaccaccatgttgaagcccttggcagcctgagagctccaaggaacaagctgtgacaaccaggagccctgtctgtgggttcgtctgcccagggcctggagcccaagccctgtgttcctggggaagctggggacttgggaagtgatgggtgtgtcatgttgcgtgtgtctgtctgtgagcctttcacacctgtgctggcgctggaaaattatttgtgctcagctgacatttaacacttcctcccccgcttcctcctagccctgtgggcaggggttggaaacttagcactttatatttatacagaacattcaggatttgtcaataaaatattgttatatttaaaaaaaaaaaaaaaaaaaaaaaaaaa

SEQ ID NO: 1035 - DNA, 1837 bp, Homo sapiens
acaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttggaaaaaaaaaaaaaaaaaa

SEQ ID NO: 1036 - DNA, 3921 bp, Homo sapiens
cggaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtaacaactttgagctcaactttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccttccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaccg

SEQ ID NO: 1037 - DNA, 749 bp, Homo sapiens
cggtgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggaccccttgggctgagcaccaagaccttgaaccttttttgttttaccttttttccaaataacagttgggagaaatatcaatgaaattctgccg

SEQ ID NO: 1038 - DNA, 3107 bp, Homo sapiens
aagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatg

SEQ ID NO: 1039 - DNA, 3805 bp, Homo sapiens
ggctcggctcctagagctgccacggccatggccagagcccgcccgccgccgccgccgtcgccgccgccggggcttctgccgctgctccctccgctgctgctgctgccgctgctgctgctgcccgccggctgccgggcgctggaagagaccctcatggacacaaaatgggtaacatctgagttggcgtggacatctcatccagaaagtgggtgggaagaggtgagtggctacgatgaggccatgaatcccatccgcacataccaggtgtgtaatgtgcgcgagtcaagccagaacaactggcttcgcacggggttcatctggcggcgggatgtgcagcgggtctacgtggagctcaagttcactgtgcgtgactgcaacagcatccccaacatccccggctcctgcaaggagaccttcaacctcttctactacgaggctgacagcgatgtggcctcagcctcctcccccttctggatggagaacccctacgtgaaagtggacaccattgcacccgatgagagcttctcgcggctggatgccggccgtgtcaacaccaaggtgcgcagctttgggccactttccaaggctggcttctacctggccttccaggaccagggcgcctgcatgtcgctcatctccgtgcgcgccttctacaagaagtgtgcatccaccaccgcaggcttcgcactcttccccgagaccctcactggggcggagcccacctcgctggtcattgctcctggcacctgcatccctaacgccgtggaggtgtcggtgccactcaagctctactgcaacggcgatggggagtggatggtgcctgtgggtgcctgcacctgtgccaccggccatgagccagctgccaaggagtcccagtgccgcccctgtccccctgggagctacaaggcgaagcagggagaggggccctgcctcccatgtccccccaacagccgtaccacctccccagccgccagcatctgcacctgccacaataacttctaccgtgcagactcggactctgcggacagtgcctgtaccaccgtgccatctccaccccgaggtgtgatctccaatgtgaatgaaacctcactgatcctcgagtggagtgagccccgggacctgggtgtccgggatgacctcctgtacaatgtcatctgcaagaagtgccatggggctggaggggcctcagcctgctcacgctgtgatgacaacgtggagtttgtgcctcggcagctgggcctgtcggagccccgggtccacaccagccatctgctggcccacacgcgctacacctttgaggtgcaggcggtcaacggtgtctcgggcaagagccctctgccgcctcgttatgcggccgtgaatatcaccacaaaccaggctgccccgtctgaagtgcccacactacgcctgcacagcagctcaggcagcagcctcaccctatcctgggcacccccagagcggcccaacggagtcatcctggactacgagatgaagtactttgagaagagcgagggcatcgcctccacagtgaccagccagatgaactccgtgcagctggacgggcttcggcctgacgcccgctatgtggtccaggtccgtgcccgcacagtagctggctatgggcagtacagccgccctgccgagtttgagaccacaagtgagagaggctctggggcccagcagctccaggagcagcttcccctcatcgtgggctccgctacagctgggcttgtcttcgtggtggctgtcgtggtcatcgctatcgtctgcctcaggaagcagcgacacggctctgattcggagtacacggagaagctgcagcagtacattgctcctggaatgaaggtttatattgacccttttacctacgaggaccctaatgaggctgttcgggagtttgccaaggagatcgacgtgtcctgcgtcaagatcgaggaggtgatcggagctggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccggctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctgggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctggcatgtcacagcccctcctggaccgcacggtcccagattacacaaccttcacgacagttggtgattggctggatgccatcaagatggggcggtacaaggagagcttcgtcagtgcggggtttgcatcttttgacctggtggcccagatgacggcagaagacctgctccgtattggggtcaccctggccggccaccagaagaagatcctgagcagtatccaggacatgcggctgcagatgaaccagacgctgcctgtgcaggtctgacaccggctcccacggggaccctgaggaccgtgcagggatgccaagcagccggctggactttcggactcttggacttttggatgcctggccttaggctgtggcccagaagctggaagtttgggaaaggcccaagctgggacttctccaggcctgtgttccctccccaggaagtgcgccccaaacctcttcatattgaagatggattaggagagggggtgatgacccctccccaagcccctcagggcccagaccttcctgctctccagcaggggatccccacaacctcacacttgtctgttcttcagtgctggaggtcctggcagggtcaggctggggtaagccggggttccacagggcccagccctggcaggggtctggccccccaggtaggcggagagcagtccctccctcaggaactggaggaggggactccaggaatggggaaatgtgacaccaccatcctgaagccagcttgcacctccagtttgcacagggatttgtcctgggggctgagggccctgtccccacccccgcccttggtgctgtcataaaagggcaggcaggggcaggctgaggagttgcccgttgccccccagagactgactctcagagccagagatgggatgtgtgagtgtgtgtgtgtgtgtgtgcgcgcgcgcgcgcgtgtgtgtgtgcacgcactggcctgcacagagagcatgggtgagcgtgtaaaagcttggccctgtgccctacagtggggacagctgggccgacagcagaataaaggcaataagatgaa

SEQ ID NO: 1040 - DNA, 4586 bp, Homo sapiens
tatacttcgctacttggctagagttgcaactacagctgggttatatggctctaatctgatggaacatactgagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggcacctgagaaaaagcaagatgttgggaaatttgttgagcttccaggtgcggagatgggaaaggttaccgtcagatttcctccagaggccagtggttacttacacattgggcatgcaaaagctgctcttctgaaccagcactaccaggttaactttaaagggaaactgatcatgagatttgatgacacaaatcctgaaaaagaaaaggaagattttgagaaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagaatctaaacatagaaaaaaccctattgagaagaatctacaaatgtgggaagaaatgaaaaaagggagccagtttggtcactcctgttgtttgcgagcaaaaattgacatgagtagtaacaatggatgcatgagagatccaaccctttatcgctgcaaaattcaaccacatccaagaactggaaataaatacaatgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatgggatgacccaagatttcctacggttcgtggtgtactgagaagagggatgacagttgaaggactgaaacagtttattgctgctcagggctcctcacgttcagtcgtgaacatggagtgggacaaaatctgggcgtttaacaaaaaggttattgacccagtggctccacgatatgttgcattactgaagaaagaagtgatcccagtgaatgtacctgaagctcaggaggagatgaaagaagtagccaaacacccaaagaatcctgaggttggcttgaagcctgtgtggtatagtcccaaagttttcattgaaggtgctgatgcagagactttttcggagggtgagatggttacatttataaattggggcaacctcaacattacaaaaatacacaaaaatgcagatggaaaaatcatatctcttgatgcaaagtttaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaagcatgaagagctaatgctaggggatccctgccttaaggatttgaaaaaaggagatattatacaactccagagaagaggattcttcatatgtgatcaaccttatgaacctgttagcccatatagttgcaaggaagccccgtgtgttttgatatacattcctgatgggcacacaaaggaaatgccaacatcagggtcaaaggaaaagaccaaagtagaagccacaaaaaatgagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggttgcttgggttacaagatctggcaaaaccgagctggcagaaccaattgccattcgtcctactagtgaaacagtaatgtatcctgcatatgcaaaatgggtacaatcacacagagacctgcccatcaagctcaatcagtggtgcaatgtggtgcgttgggaattcaagcatcctcagcctttcctacgtactcgtgaatttctttggcaggaagggcacagtgcttttgctaccatggaagaggcagcggaagaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaagggcttctgaagaccttaagactcatatggttgtggctaatacaatggaagactttcagaagatactagattctggaaagattgttcagattccattctgtggggaaattgactgtgaggactggatcaaaaagaccactgccagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaacta

SEQ ID NO: 1041 - DNA, 2402 bp, Homo sapiens
agctcacagcaagtccaggctagaggtagaaacgtgagagccccacggctggggaagattgccatgggattggagatgagctccaaggacagccctggcagtctggatggaagagcttgggaagatgctcagaaaccacaaagtgcctggtgcggtgggaggaaaaccagagtgtatgctacaagcagccggcgggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgagccgaggctgtggagcagctgcgagaagctcctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgcacagcctgctggcagggccagggctaatgccatcagcccctgggaacaggccccacgccctctcctccccctcctagggggtgtcagaagctgggaacgtgtgtccaggctctgggcacagtgctgccccttgcaagccataacggtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctc

SEQ ID NO: 1042 - DNA, 4071 bp, Homo sapiens
gagtccagccgctggtgcgcggagcggttcaccgtcttcggagcggttcggcccagcctttcgcccaggcgcccaggcccgctgcgcgcgtgcgtgagcgcgcctgcgccgccagggccgctgcaaggggaggagagcggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatgatgtgacaatctcgatcgatcatggactactaaatggcctttacatagaagggctctgatttgcacaatttgttgaaaaatcacaaacccatagaaaagtgagtaggctaagttggggaggctcaaaccattaagggttaaaaatacatcttaaacattggaaagctcttctagctgaatctgaaatattaccccttgtctagaaaaaggggggcagtcagaacagctgttccccactccgtgttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaatgtgcactgtgtctttagccagggccgtgcaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttagctgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttttttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcaccctgcgcagggccgtatgcatcctgccaagctgcgttatattctgtactgtgtacaataaagaagtttgcttttcgttta

SEQ ID NO: 1043 - DNA, 2576 bp, Homo sapiens
gaattccgggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaattttggaggccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgtttgttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgaaaaaaaaaaaaaaaaaa

SEQ ID NO: 1044 - DNA, 5043 bp, Homo sapiens
cgggattcggctggctctgccacaccaccgcgcgcccccgctccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacatttaaaaacgctatggcaaagagaataaaagctaagcccacttcagacaaacctggaagtccatatcgctctgtcacacacttcgactcactagctgtaatagacatccctggagcagatactctggataaattatttgaccatgctgtatccaagtttgggaagaaggacagccttgggaccagggaaatcctaagtgaagaaaatgaaatgcagccaaatggaaaagtttttaagaagttaattcttgggaattataaatggatgaactatcttgaagtgaatcgcagagtgaataactttggtagtggactcactgcactgggactaaaaccaaagaacaccattgccatcttctgtgagaccagggccgaatggatgattgcagcacagacctgctttaagtacaactttcctcttgtgactttatatgccacacttggcaaagaagcagtagttcatgggctaaatgaatctgaggcttcctatctgattaccagtgttgaacttctggaaagtaaacttaagactgcattgttagatatcagttgtgttaaacatatcatttatgtggacaataaggctatcaataaagcagagtaccctgaaggatttgagattcacagcatgcaatcagtagaagagttgggatctaacccagaaaacttgggcattcctccaagtagaccaacgccttcagacatggccattgttatgtatactagtggttctactggccgacctaagggagtgatgatgcatcatagcaatttgatagctggaatgacaggccagtgtgaaagaatacctggactgggaccgaaggacacatatattggctacttgcctttggctcatgtgctagaactgacagcagagatatcttgctttacctatggctgcaggattggatattcttctccgcttacactctctgaccagtccagcaaaattaaaaaaggaagcaaaggagactgtactgtactgaagcccacacttatggctgctgttccggaaatcatggatagaatttataagaatgttatgagcaaagtccaagagatgaattatattcagaaaactctgttcaagatagggtatgattacaaattggaacagatcaaaaagggatatgatgcacctctttgcaatctgttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaagtaactgactatactactggcagagttggagcacctcttatttgctgtgaaattaagctaaaagactggcaagaaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattatagatcgtaagaaagatctagtgaagttacaagcaggagagtatgtatctcttgggaaagtagaagctgcactgaagaattgtccacttattgacaacatctgtgcttttgccaaaagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccatgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaagtttagcaaagcggggttataatgaatgacttccccaatatcttgcttgaacttacagtgattaacttggatgagttttgggaagttaaagggaagaaaacactgttatcattttttcctgtttgggaagagcttagaaactggaaatactagatttgggagaagggcagagttacttgataagggacttgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattccttccctggttgtttatcccttaggaatgagtttcttagactttcccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaaaaaaaaaaaaaaaaaaa

SEQ ID NO: 1045 - DNA, 2487 bp, Homo sapiens
actcagccctggcctcgccgagctctgttcttagactctcacccgtcccgcacgttcctggtcgcctggcgttctgattcgcccgcccgggccccgccaccccctcctcagctgacggggcaaaagctgctccgagaggagaaggtcaagtcctccgcccgggccgggccgagcggagcccagggagcgcagcatccgcgcggctaccgcggcggcgcaggagttataaagtcggcgcgcgagactccgccgccacccggcagccccggcgcagctccggcagccgcagtcgcagcgcccccagcgtggcgccccccggccgggcctgccgcccgggacccgggctggggcgcagagggagcccggagcccggcgcccccatgcgccgccccgccgccgccgcgccacagctatgaccctgagcactgagatgtccgatgcctctggcctcgccgaggaaacagacatcgacgtggtgggggagggcgaggacgaagaagacgaggaagaggaggacgacgacgagggcggcggtggcgggccccggctggctgtccccgcgcagcggcggcggcggcggcgctcgtacgccggggaggacgagctggaggatctggaggaggaggaggacgacgatgacatcctgctggccccgcctgctgggggctccccggcgcccccgggcccggccccggcggcgggggcaggagccggtgggggcggcggcggcggcggcgcgggcggcggcgggagcgcgggtagcggcgccaagaacccgctggtgaagccgccctactcgtatatcgcgctcatcactatggccatcctgcagagccccaagaagcggctgacgctgagcgagatctgtgagttcatcagcggccgcttcccctactaccgggagaagttccccgcctggcagaacagcatccgccacaacctctcgctcaacgactgcttcgtcaagatcccccgcgagcccggcaacccgggcaagggcaactactggacgctggacccggagtccgccgacatgttcgacaacggcagcttcctgcgccggaggaagcgcttcaagcggcagccgctgctcccacccaacgccgcggccgccgagtctctgctgctgcgcggcgcgggagccgcagggggcgcgggcgacccggcagccgccgccgcgctcttcccgcccgcgcccccgccgcccccgcatgcctacggctacggcccctacggctgcggctacggcctgcagctgccgccttacgcgccgccctcggccctcttcgccgccgcagcggccgccgccgccgccgccgccttccacccgcactcgcccccgccgcccccgccaccgcacggcgcggccgccgagctggcccggaccgccttcggctaccggccgcacccgctcggcgccgccctacccggccccctgccggcctccgcggccaaggcgggcggcccgggcgcctcagcgctggcgcgctcgcccttctccatcgagagcatcatcgggggcagcttgggcccggccgccgctgccgccgccgccgcgcaggccgccgccgccgctcaggcctcgccctcgccctcgccggtggcggcgccgccagctcccggatccagcggaggaggctgcgcggcgcaggcggccgtgggcccggcggccgcgctcacccgatccctcgtggccgccgcggccgccgccgcctcctcagtctcctcgtccgccgccttggggactctgcaccaagggactgccctgtccagtgtcgagaactttactgctaggatttccaattgttaataacgctatgttagcgcgctcgaggaagaaggtaggaatcccggctccttttctcgtcttggtggttcggtgttttgttcgctcctccaggcgcggcccctctcgacctcgcgcgcccattttcgccgctgcgaattctcggacaaaactgtcaacagcccgggcgcgccttttggctctgcgggtccctctatttatgcaaagccgacctatgctacagccccccaacccccgacctggggtagggaggaagagggtgccggggaagggagtccgccctgtccaggcactagaggctcccttgacgtttggcagatgaaaaacaactaagcctttttgaggtgtagagattctcaggtccaggcgttaaaaaataatggtcaaaagaataatacaaaaatagtaaaggtcttgaagaatgccagcgaagcaattcttttttatttgaggacacttgtctggtgtactttttcatgaaaaggaaaaatggttaacatgtttacacaagaaaaaaagtcaaaattatcatttatttcaacctgtgttttgtatcataacagacgtgtggatttttttgtacttactgcgtattctttacaaggagtattgtaaattttactggcaattattattgtactattctaaatgtaagatttttacactttttcagaaataaa

SEQ ID NO: 1046 - DNA, 3280 bp, Homo sapiens
  Modified_base 4, 36, 50, 56, 60: n = a,c,g, or t
ggcncgacccgagcagccggttccctcctctccagnccccctcctcattncacccncgcngcctggcccagcgacccgtcccttcgtctccccgcggaatggggccggcactgctcagggtcgcgcgccctggacccagctcgctctcggtctcgcgctgtcaggactgcccggctcgcgccgcctcgcgctctgcctcagtcagtggcccgaacgtccgttaagcggcggcgcggttcctgtttccgtttcttcctctccgttcggtcgggagtagcatcctccactcagccacccttcccactcccccatcgtggggcagctgcggctgagggctgtggctttggcagctgcgacggggagcggcggagaccgtctgctcccgcctggggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacagcagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttgagccaaactgtagatgaagagggctctgatctaacaaaataaggttatatgagtagatactctcagcaccaagagcagctgggaactgacataggcttcaattggtggaattcctctttaacaagggctgcaatgcctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaaagtttctagaattttatatcattggatgatatgttgatcagccttatgtggaagaactgtgataaaaagaggagctttttagtttttcaaaaaaaa

SEQ ID NO: 1047 - DNA, 3874 bp, Homo sapiens
atggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgtcttcggtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtattttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttattattttttatctatgtggaaaacacaataaaaaatcctcaacactattgtaatcatttggttaagtgcttattcctcttttgggtaaaatctgtaattgataataggtgggggaaaatgaattttgtatgctgaatttctaagcgcctattgtttgtaaaaccatcagatatttcttatggcacaaaaaatgaggaatagcaaaattcctgtgttcaatatttagaaaattttgtattaatttctgataaagttccttaagcatctgatagaatgatgttttaaaaaaatttgacgcttgcttaggagatttaccactttttttttttgtttttcgtcattttatatttagatctcctgtattcttgttcccgaagtaaaatacgatcggtttcatattttaaatctggcagagcctcagctgtacgaaaaagagcatatactggttattgaccctatcttctcattgtttgtttgtaagtttgaatttgtattaaaaagcctgcattctgagctggacatggtggctcagcttctaatcccagcactttggtaggcaaaggtgggaggatcatttgagctcaggagttccagaccagcctgggcaacatagcaaaatctcatctctacaaaaagtaaaaattaaaaaatgaaattaaaaataaaattacctaggtgtggtggcacgcatctgtagttccagctatacaggaaggtgaggcagaagcattgcttgagcttgggagatcgaggctacagtgagctatgattacaccactgcacttcagtctgtgtgactgagcaagactctttcaaaaaaaaaaaaaagcctacattctccagttgattatttccaactaatgtgtattatgtgcctaattttctatcagaagttgtattaagcccgttttcacactgctgttaaagacatacctgagactgggtaatttataaagaaaaataggttcaatggacccacaggtccgcgtggctggggaagcttcacaatcatggcggaaggtgaaagcatgtcttacgtggaag

SEQ ID NO: 1048 - DNA, 2376 bp, Homo sapiens
gaggaggagtggggaccgggcggggggtggaggaagaggcctcgcgcagaggagggagcaattgaatttcaaacacaaacaactcgacgagcgcgcacccaccgcgccggagccttgccccgatccgcgcccgccccgtccgtgcggcgcgcgggcggagacgccgtggccgcgccggagctcgggccgggggccaccatcgaggcgggggccgcgcgagggccggagcggagcggcgccgccaccgccgcacgcgcaaacttgggctcgcgcttcccggcccggcgcggagcccggggcgcccggagccccgccatgtcgcgatccaaccggcagaaggagtacaaatgcggggacctggtgttcgccaagatgaagggctacccacactggccggcccggattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattact

SEQ ID NO: 1049 - DNA, 2872 bp, Homo sapiens
tccaggaatcgatagtgcattcgtgcgcgcggccgcccgtcgcttcgcacagggctggatggttgtattgggcagggtggctccaggatgttaggaactgtgaagatggaagggcatgaaaccagcgactggaacagctactacgcagacacgcaggaggcctactcctcggtcccggtcagcaacatgaactcaggcctgggctccatgaactccatgaacacctacatgaccatgaacaccatgactacgagcggcaacatgaccccggcgtccttcaacatgtcctatgccaacccggccttaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgatgaatggcctgggcccctacgcggccgccatgaacccgtgcatgagccccatggcgtacgcgccgtccaacctgggccgcagccgcgcgggcggcggcggcgacgccaagacgttcaagcgcagttacccgcacgccaagccgccctactcgtacatctcgctcatcaccatggccatccagcgggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggccccgggcccggccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatccaacaactatttttatttcatttttcatgcacaaccttgcccccagtgcaaaagactgttactttattattgtattcaaaattcattgtgtatattactacaaagacggccccaaaccaatttttttcctgcgaagtttaatgatccacaagtgtatatatgaaattctcctccttccttgcccccctctctttcttccctcttggccctccagacattctagtttgtggagggttatttaaaaaacaaaaaggaagatggtcaagtttgtaaaatatttgtttgtgcttttcccccctccttacctgaccccctacgagtttacaggcttgtggcaatactcttaaccataagaattgaaatggtgaagaaacaagtatacactagaggctcttaaaagtattgaaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacgtgatacgttctcaagagttgcttgaccgaaagttacaaggaccccaacccctttgctctctacccacagatggccctgggaacaatcctcaggaattgccctcaagaactcgcttctttgctttgagagtgccatggtcatgtcattctgaggtacataacacataaattagtttctatgagtgtataccatttaaagattttttcagtaaagggaatattacatgttgggaggaggagataagttatagggagctggatttcaaacggtggtccaagattcaaaaatcctattgatagtggccattttaatcattgccatcgtgtgcttgtttcatccagtgttatgcactttccacagttggtgttagtatagccagagggtttcattattatttctctttgctttctcaatgttaatttattgcatggtttattctttttctttacagctgaaattgctttaaatgatggttaaaattacaaattaaattgggaatttttatcaatgtgattgtaattaaaaatattttgatttaaataacaaaaataataccagattttaagccgcggaaaatgttcttgatcatttgcagttaaggactttaaataaatcaaatgttaacaaaaaa

SEQ ID NO: 1050 - DNA, 1608 bp, Homo sapiens
agaactagtctcgagtttttttttgtctgtcctggattggagccgtccctataaccatctagttccgagtacaaactggagacagaaataaatattaaagaaatcatagaccgaccaggtaaaggcaaagggatgaattcctacttcactaacccttccttatcctgccacctcgccgggggccaggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttctccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggccggcctggcagccggggagggccggagcggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaa

SEQ ID NO: 1051 - DNA, 2584 bp, Homo sapiens
tggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcgcaaccgaaagtgcttcgactgcgaccagcgcggccccacctacgttaacatgacggtcggctccttcgtgtgtacctcctgctccggcagcctgcgaggattaaatccaccacacagggtgaaatctatctccatgacaacattcacacaacaggaaattgaattcttacaaaaacatggaaatgaagtctgtaaacagatttggctaggattatttgatgatagatcttcagcaattccagacttcagggatccacaaaaagtgaaagagtttctacaagaaaagtatgaaaagaaaagatggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcagctcagaattctgcaaatgcagattttgcaaactttgatgcatttggacagtctagtggttcgagtaattttggaggtttccccacagcaagtcactctccttttcagccccaaactacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcagcaatgtttttggaacagtgccagtggttgcttctgcacagacacagcctgcttcatcaagtgtgcctgctccatttggacgtacgccttccacaaatccatttgttgctgctgctggtccttctgtggcatcttctacaaacccatttcagaccaatgccagaggagcaacagcggcaacctttggcactgcatccatgagcatgcccacgggattcggcactcctgctccctacagtcttcccaccagctttagtggcagctttcagcagcctgcctttccagcccaagcagctttccctcaacagacagctttttctcaacagcccaatggtgcaggttttgcagcatttggacaaacaaagccagtagtaaccccttttggtcaagttgcagctgctggagtatctagtaatccttttatgactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaataaaaaaaaaaaaaaagaaaaaaaaaa

SEQ ID NO: 1052 - DNA, 1552 bp, Homo sapiens
cggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaaagaaccacctcaaggagaggaagaagaaagcatggaaactcaggagtgacattcccttcactccttttcctacccaagggaaagactggagcctaagctgcctgctactggctttacatggtgacagacattccgtggataggaagatagcaggagaaagtaactccatagagtgtcattccactggttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtactt

SEQ ID NO: 1053 - DNA, 6927 bp, Homo sapiens
gatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttatttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttg

SEQ ID NO: 1054 - DNA, 4908 bp, Homo sapiens
acctgcgtgcagtcggtcctccaggccacgcagcgcccgagagtaccagggagactccggcccctgtcggcgccaagcccctccgcccctcacagcgcccaggtccgcggccgggccttgattttttggcggggaccgtcatggcgtcgcagccaaattcgtctgcgaagaagaaagaggagaaggggaagaacatccaggtggtggtgagatgcagaccatttaatttggcagagcggaaagctagcgcccattcaatagtagaatgtgatcctgtacgaaaagaagttagtgtacgaactggaggattggctgacaagagctcaaggaaaacatacacttttgatatggtgtttggagcatctactaaacagattgatgtttaccgaagtgttgtttgtccaattctggatgaagttattatgggctataattgcactatctttgcgtatggccaaactggcactggaaaaacttttacaatggaaggtgaaaggtcacctaatgaagagtatacctgggaagaggatcccttggctggtataattccacgtacccttcatcaaatttttgagaaacttactgataatggtactgaattttcagtcaaagtgtctctgttggagatctataatgaagagctttttgatcttcttaatccatcatctgatgtttctgagagactacagatgtttgatgatccccgtaacaagagaggagtgataattaaaggtttagaagaaattacagtacacaacaaggatgaagtctatcaaattttagaaaagggggcagcaaaaaggacaactgcagctactctgatgaatgcatactctagtcgttcccactcagttttctctgttacaatacatatgaaagaaactacgattgatggagaagagcttgttaaaatcggaaagttgaacttggttgatcttgcaggaagtgaaaacattggccgttctggagctgttgataagagagctcgggaagctggaaatataaatcaatccctgttgactttgggaagggtcattactgcccttgtagaaagaacacctcatgttccttatcgagaatctaaactaactagaatcctccaggattctcttggagggcgtacaagaacatctataattgcaacaatttctcctgcatctctcaatcttgaggaaactctgagtacattggaatatgctcatagagcaaagaacatattgaataagcctgaagtgaatcagaaactcaccaaaaaagctcttattaaggagtatacggaggagatagaacgtttaaaacgagatcttgctgcagcccgtgagaaaaatggagtgtatatttctgaagaaaattttagagtcatgagtggaaaattaactgttcaagaagagcagattgtagaattgattgaaaaaattggtgctgttgaggaggagctgaatagggttacagagttgtttatggataataaaaatgaacttgaccagtgtaaatctgacctgcaaaataaaacacaagaacttgaaaccactcaaaaacatttgcaagaaactaaattacaacttgttaaagaagaatatatcacatcagctttggaaagtactgaggagaaacttcatgatgctgccagcaagctgcttaacacagttgaagaaactacaaaagatgtatctggtctccattccaaactggatcgtaagaaggcagttgaccaacacaatgcagaagctcaggatatttttggcaaaaacctgaatagtctgtttaataatatggaagaattaattaaggatggcagctcaaagcaaaaggccatgctagaagtacataagaccttatttggtaatctgctgtcttccagtgtctctgcattagataccattactacagtagcacttggatctctcacatctattccagaaaatgtgtctactcatgtttctcagatttttaatatgatactaaaagaacaatcattagcagcagaaagtaaaactgtactacaggaattgattaatgtactcaagactgatcttctaagttcactggaaatgattttatccccaactgtggtgtctatactgaaaatcaatagtcaactaaagcatattttcaagacttcattgacagtggccgataagatagaagatcaaaaaaaggaactagatggctttctcagtatactgtgtaacaatctacatgaactacaagaaaataccatttgttccttggttgagtcacaaaagcaatgtggaaacctaactgaagacctgaagacaataaagcagacccattcccaggaactttgcaagttaatgaatctttggacagagagattctgtgctttggaggaaaagtgtgaaaatatacagaaaccacttagtagtgtccaggaaaatatacagcagaaatctaaggatatagtcaacaaaatgacttttcacagtcaaaaattttgtgctgattctgatggcttctcacaggaactcagaaattttaaccaagaaggtacaaaattggttgaagaatctgtgaaacactctgataaactcaatggcaacctggaaaaaatatctcaagagactgaacagagatgtgaatctctgaacacaagaacagtttatttttctgaacagtgggtatcttccttaaatgaaagggaacaggaacttcacaacttattggaggttgtaagccaatgttgtgaggcttcaagttcagacatcactgagaaatcagatggacgtaaggcagctcatgagaaacagcataacatttttcttgatcagatgactattgatgaagataaattgatagcacaaaatctagaacttaatgaaaccataaaaattggtttgactaagcttaattgctttctggaacaggatctgaaactggatatcccaacaggtacgacaccacagaggaaaagttatttatacccatcaacactggtaagaactgaaccacgtgaacatctccttgatcagctgaaaaggaaacagcctgagctgttaatgatgctaaactgttcagaaaacaacaaagaagagacaattccggatgtggatgtagaagaggcagttctggggcagtatactgaagaacctctaagtcaagagccatctgtagatgctggtgtggattgttcatcaattggcggggttccatttttccagcataaaaaatcacatggaaaagacaaagaaaacagaggcattaacacactggagaggtctaaagtggaagaaactacagagcacttggttacaaagagcagattacctctgcgagcccagatcaacctttaattcacttgggggttggcaattttatttttaaagaaaacttaaaaataaaacctgaaaccccagaacttgagccttgtgtatagattttaaaagaatatatatatcagccgggcgcggtggctcatgcctgtaatcccagcactttgggaggctgaggcgggtggattgcttgagcccaggagtttgagaccagcctggccaacgtggcaaaacctcgtctctgttaaaaattagccgggcgtggtggcacactcctgtaatcccagctactggggaggctgaggcacgagaatcacttgaacccaggaagcggggttgcagtgagccaaaggtacaccactacactccagcctgggcaacagagcaagactcggtctcaaaaacaaaatttaaaaaagatataaggcagtactgtaaattcagttgaattttgatatctacccatttttctgtcatccctatagttcactttgtattaaattgggtttcatttgggatttgcaatgtaaatacgtatttctagttttcatataaagtagttcttttataacaaatgaaaagtatttttcttgtatattattaagtaatgaatatataagaactgtactcttctcagcttgagcttaacataggtaaatatcaccaacatctgtccttagaaaggaccatctcatgttttttttcttgctatgacttgtgtattttcttgcatcctccctagacttccctatttcgctttctcctcggctcactttctccctttttatttttcaccaaaccatttgtagagctacaaaacctatcctttcttattttcagtagtcagaattttatctagaaatcttttaacacctttttagtggttatttctaaaatcactgtcaacaataaatctaaccctagttgtatccctcctttaagtatttaaaacttgttgccccaaatgtgaaagcatttaattcctttaagaggcctaactcattcaccctgacagagttcacaaaaagcccactttagagtatacattgctattatgggagaccacccagacatctgactaatggctctgtgccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatcttaacccttaggactctggtatttttgatctggcaaccatatttctggaagttgagatgtttcagcttgaagaaccaaaacagaaggaatatgtacaaagaataaattttctgctcacgatgagtttagtgtgtaaagtttagagacatctgactttgatagctaaattaaaccaaaccctattgaagaattgaatatatgctacttcaagaaactaaattgatctcgtagaattatcttaataaaataatggctataatttctctgcaaaatcagatgtcagcataagcgatggataatacctaataaactgccctcagtaaatccatggttaataaatgtggtttctacatt

SEQ ID NO: 1055 - DNA, 14392 bp, Homo sapiens
gcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagcgccggccagtggccaagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccagctcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgatgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttggttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgttctcagccacagaacagataatgatggtttgggtttccgttgcaagtgcacattcggcttccaactggatacagatgagcgccactgcattgctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacggagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcgggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcaatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaatatgagaggttctttccggtgctcgtgtgatacaggctacatgttagaaagtgatgggaggacttgcaaagttacagcatctgagagtctgctgttacttgtggcaagtcagaacaaaattattgccgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaatgagcatctactgttctggtctgactggggccaccaccctcgcatcgagcgagccagcatggacggcagcatgcgcactgtcattgtccaggacaagatcttctggccctgcggcttaactattgactaccccaacagactgctctacttcatggactcctatcttgattacatggacttttgcgattataatggacaccatcggagacaggtgatagccagtgatttgattatacggcacccctatgccctaactctctttgaagactctgtgtactggactgaccgtgctactcgtcgggttatgcgagccaacaagtggcatggagggaaccagtcagttgtaatgtataatattcaatggccccttgggattgttgcggttcatccttcgaaacaaccaaattccgtgaatccatgtgccttttcccgctgcagccatctctgcctgctttcctcacaggggcctcatttttactcctgtgtttgtccttcaggatggagtctgtctcctgatctcctgaattgcttgagagatgatcaacctttcttaataactgtaaggcaacatataatttttggaatctcccttaatcctgaggtgaagagcaatgatgctatggtccccatagcagggatacagaatggtttagatgttgaatttgatgatgctgagcaatacatctattgggttgaaaatccaggtgaaattcacagagtgaagacagatggcaccaacaggacagtatttgcttctatatctatggtggggccttctatgaacctggccttagattggatttcaagaaacctttattctaccaatcctagaactcagtcaatcgaggttttgacactccacggagatatcagatacagaaaaacattgattgccaatgatgggacagctcttggagttggctttccaattggcataactgttgatcctgctcgtgggaagctgtactggtcagaccaaggaactgacagtggggttcctgccaagatcgccagtgctaacatggatggcacatctgtgaaaactctctttactgggaacctcgaacacctggagtgtgtcactcttgacatcgaagagcagaaactctactgggcagtcactggaagaggagtgattgaaagaggaaacgtggatggaacagatcggatgatcctggtacaccagctttcccacccctggggaattgcagtccatgattctttcctttattatactgatgaacagtatgaggtcattgaaagagttgataaggccactggggccaacaaaatagtcttgagagataatgttccaaatctgaggggtcttcaagtttatcacagacgcaatgccgccgaatcctcaaatggctgtagcaacaacatgaatgcctgtcagcagatttgcctgcctgtaccaggaggattgttttcctgcgcctgtgccactggatttaaactcaatcctgataatcggtcctgctctccatataactctttcattgttgtttcaatgctgtctgcaatcagaggctttagcttggaattgtcagatcattcagaaaccatggtgccggtggcaggccaaggacgaaacgcactgcatgtggatgtggatgtgtcctctggctttatttattggtgtgattttagcagctcagtggcatctgataatgcgatccgtagaattaaaccagatggatcttctctgatgaacattgtgacacatggaataggagaaaatggagtccggggtattgcagtggattgggtagcaggaaatctttatttcaccaatgcctttgtttctgaaacactgatagaagttctgcggatcaatactacttaccgccgtgttcttcttaaagtcacagtggacatgcctaggcatattgttgtagatcccaagaacagatacctcttctgggctgactatgggcagagaccaaagattgagcgttctttccttgactgtaccaatcgaacagtgcttgtgtcagagggcattgtcacaccacggggcttggcagtggaccgaagtgatggctacgtttattgggttgatgattctttagatataattgcaaggattcgtatcaatggagagaactctgaagtgattcgttatggcagtcgttacccaactccttatggcatcactgtttttgaaaattctatcatatgggtagataggaatttgaaaaagatcttccaagccagcaaggaaccagagaacacagagccacccacagtgataagagacaatatcaactggctaagagatgtgaccatctttgacaagcaagtccagccccggtcaccagcagaggtcaacaacaacccttgcttggaaaacaatggtgggtgctctcatctctgctttgctctgcctggattgcacaccccaaaatgtgactgtgcctttgggaccctgcaaagtgatggcaagaattgtgccatttcaacagaaaatttcctcatctttgccttgtctaattccttgagaagcttacacttggaccctgaaaaccatagcccacctttccaaacaataaatgtggaaagaactgtcatgtctctagactatgacagtgtaagtgatagaatctacttcacacaaaatttagcctctggagttggacagatttcctatgccaccctgtcttcagggatccatactccaactgtcattgcttcaggtatagggactgctgatggcattgcctttgactggattactagaagaatttattacagtgactacctcaaccagatgattaattccatggctgaagatgggtctaaccgcactgtgatagcccgcgttccaaaaccaagagcaattgtgttagatccctgccaagggtacctgtactgggctgactgggatacacatgccaaaatcgagagagccacattgggaggaaacttccgggtacccattgtgaacagcagtctggtcatgcccagtgggctgactctggactatgaagaggaccttctctactgggtggatgctagtctgcagaggattgaacgcagcactctgacgggcgtggatcgtgaagtcattgtcaatgcagccgttcatgcttttggcttgactctctatggccagtatatttactggactgacttgtacacacaaagaatttaccgagctaacaaatatgacgggtcaggtcagattgcaatgaccacaaatttgctctcccagcccaggggaatcaacactgttgtgaagaaccagaaacaacagtgtaacaatccttgtgaacagtttaatgggggctgcagccatatctgtgcaccaggtccaaatggtgccgagtgccagtgtccacatgagggcaactggtatttggccaacaacaggaagcactgcattgtggacaatggtgaacgatgtggtgcatcttccttcacctgctccaatgggcgctgcatctcggaagagtggaagtgtgataatgacaacgactgtggggatggcagtgatgagatggaaagtgtctgtgcacttcacacctgctcaccgacagccttcacctgtgccaatgggcgatgtgtccaatactcttaccgctgtgattactacaatgactgtggtgatggcagtgatgaggcagggtgcctgttcagggactgcaatgccaccacggagtttatgtgcaataacagaaggtgcatacctcgtgagtttatctgcaatggtgtagacaactgccatgataataacacttcagatgagaaaaattgccctgatcgcacttgccagtctggatacacaaaatgtcataattcaaatatttgtattcctcgcgtttatttgtgtgacggagacaatgactgtggagataacagtgatgaaaaccctacttattgcaccactcacacatgcagcagcagtgagttccaatgcgcatctgggcgctgtattcctcaacattggtattgtgatcaagaaacagattgttttgatgcctctgatgaacctgcctcttgtggtcactctgagcgaacatgcctagctgatgagttcaagtgtgatggtgggaggtgcatcccaagcgaatggatctgtgacggtgataatgactgtggggatatgagtgacgaggataaaaggcaccagtgtcagaatcaaaactgctcggattccgagtttctctgtgtaaatgacagacctccggacaggaggtgcattccccagtcttgggtctgtgatggcgatgtggattgtactgacggctacgatgagaatcagaattgcaccaggagaacttgctctgaaaatgaattcacctgtggttacggactgtgtatcccaaagatattcaggtgtgaccggcacaatgactgtggtgactatagcgacgagaggggctgcttataccagacttgccaacagaatcagtttacctgtcagaacgggcgctgcattagtaaaaccttcgtctgtgatgaggataatgactgtggagacggatctgatgagctgatgcacctgtgccacaccccagaacccacgtgtccacctcacgagttcaagtgtgacaatgggcgctgcatcgagatgatgaaactctgcaaccacctagatgactgtttggacaacagcgatgagaaaggctgtggcattaatgaatgccatgacccttcaatcagtggctgcgatcacaactgcacagacaccttaaccagtttctattgttcctgtcgtcctggttacaagctcatgtctgacaagcggacttgtgttgatattgatgaatgcacagagatgccttttgtctgtagccagaagtgtgagaatgtaataggctcctacatctgtaagtgtgccccaggctacctccgagaaccagatggaaagacctgccggcaaaacagtaacatcgaaccctatctcatttttagcaaccgttactatttgagaaatttaactatagatggctatttttactccctcatcttggaaggactggacaatgttgtggcattagattttgaccgagtagagaagagattgtattggattgatacacagaggcaagtcattgagagaatgtttctgaataagacaaacaaggagacaatcataaaccacagactaccagctgcagaaagtctggctgtagactgggtttccagaaagctctactggttggatgcccgcctggatggcctctttgtctctgacctcaatggtggacaccgccgcatgctggcccagcactgtgtggatgccaacaacaccttctgctttgataatcccagaggacttgcccttcaccctcaatatgggtacctctactgggcagactggggtcaccgcgcatacattgggagagtaggcatggatggaaccaacaagtctgtgataatctccaccaagttagagtggcctaatggcatcaccattgattacaccaatgatctactctactgggcagatgcccacctgggttacatagagtactctgatttggagggccaccatcgacacacggtgtatgatggggcactgcctcaccctttcgctattaccatttttgaagacactatttattggacagattggaatacaaggacagtggaaaagggaaacaaatatgatggatcaaatagacagacactggtgaacacaacacacagaccatttgacatccatgtgtaccatccatataggcagcccattgtgagcaatccctgtggtaccaacaatggtggctgttctcatctctgcctcatcaagccaggaggaaaagggttcacttgcgagtgtccagatgacttccgcacccttcaactgagtggcagcacctactgcatgcccatgtgctccagcacccagttcctgtgcgctaacaatgaaaagtgcattcctatctggtggaaatgtgatggacagaaagactgctcagatggctctgatgaactggccctttgcccgcagcgcttctgccgactgggacagttccagtgcagtgacggcaactgcaccagcccgcagactttatgcaatgctcaccaaaattgccctgatgggtctgatgaagaccgtcttctttgtgagaatcaccactgtgactccaatgaatggcagtgcgccaacaaacgttgcatcccagaatcctggcagtgtgacacatttaacgactgtgaggataactcagatgaagacagttcccactgtgccagcaggacctgccggccgggccagtttcggtgtgctaatggccgctgcatcccgcaggcctggaagtgtgatgtggataatgattgtggagaccactcggatgagcccattgaagaatgcatgagctctgcccatctctgtgacaacttcacagaattcagctgcaaaacaaattaccgctgcatcccaaagtgggccgtgtgcaatggtgtagatgactgcagggacaacagtgatgagcaaggctgtgaggagaggacatgccatcctgtgggggatttccgctgtaaaaatcaccactgcatccctcttcgttggcagtgtgatgggcaaaatgactgtggagataactcagatgaggaaaactgtgctccccgggagtgcacagagagcgagtttcgatgtgtcaatcagcagtgcattccctcgcgatggatctgtgaccattacaacgactgtggggacaactcagatgaacgggactgtgagatgaggacctgccatcctgaatattttcagtgtacaagtggacattgtgtacacagtgaactgaaatgcgatggatccgctgactgtttggatgcgtctgatgaagctgattgtcccacacgctttcctgatggtgcatactgccaggctactatgttcgaatgcaaaaaccatgtttgtatcccgccatattggaaatgtgatggcgatgatgactgtggcgatggttcagatgaagaacttcacctgtgcttggatgttccctgtaattcaccaaaccgtttccggtgtgacaacaatcgctgcatttatagtcatgaggtgtgcaatggtgtggatgactgtggagatggaactgatgagacagaggagcactgtagaaaaccgacccctaaaccttgtacagaatatgaatataagtgtggcaatgggcattgcattccacatgacaatgtgtgtgatgatgccgatgactgtggtgactggtccgatgaactgggttgcaataaaggaaaagaaagaacatgtgctgaaaatatatgcgagcaaaattgtacccaattaaatgaaggaggatttatctgctcctgtacagctgggttcgaaaccaatgtttttgacagaacctcctgtctagatatcaatgaatgtgaacaatttgggacttgtccccagcactgcagaaataccaaaggaagttatgagtgtgtctgtgctgatggcttcacgtctatgagtgaccgccctggaaaacgatgtgcagctgagggtagctctcctttgttgctactgcctgacaatgtccgaattcgaaaatataatctctcatctgagaggttctcagagtatcttcaagatgaggaatatatccaagctgttgattatgattgggatcccaaggacataggcctcagtgttgtgtattacactgtgcgaggggagggctctaggtttggtgctatcaaacgtgcctacatccccaactttgaatccggccgcaataatcttgtgcaggaagttgacctgaaactgaaatacgtaatgcagccagatggaatagcagtggactgggttggaaggcatatttactggtcagatgtcaagaataaacgcattgaggtggctaaacttgatggaaggtacagaaagtggctgatttccactgacctggaccaaccagctgctattgctgtgaatcccaaactagggcttatgttctggactgactggggaaaggaacctaaaatcgagtctgcctggatgaatggagaggaccgcaacatcctggttttcgaggaccttggttggccaactggcctttctatcgattatttgaacaatgaccgaatctactggagtgacttcaaggaggacgttattgaaaccataaaatatgatgggactgataggagagtcattgcaaaggaagcaatgaacccttacagcctggacatctttgaagaccagttatactggatatctaaggaaaagggagaagtatggaaacaaaataaatttgggcaaggaaagaaagagaaaacgctggtagtgaacccttggctcactcaagttcgaatctttcatcaactcagatacaataagtcagtgcccaacctttgcaaacagatctgcagccacctctgccttctgagacctggaggatacagctgtgcctgtccccaaggctccagctttatagaggggagcaccactgagtgtgatgcagccatcgaactgcctatcaacctgccccccccatgcaggtgcatgcacggaggaaattgctattttgatgagactgacctccccaaatgcaagtgtcctagcggctacaccggaaaatattgtgaaatggcgttttcaaaaggcatctctccaggaacaaccgcagtagctgtgctgttgacaatcctcttgatcgtcgtaattggagctctggcaattgcaggattcttccactatagaaggaccggctcccttttgcctgctctgcccaagctgccaagcttaagcagtctcgtcaagccctctgaaaatgggaatggggtgaccttcagatcaggggcagatcttaacatggatattggagtgtctggttttggacctgagactgctattgacaggtcaatggcaatgagtgaagactttgtcatggaaatggggaagcagcccataatatttgaaaacccaatgtactcagccagagacagtgctgtcaaagtggttcagccaatccaggtgactgtatctgaaaatgtggataataagaattatggaagtcccataaacccttctgagatagttccagagacaaacccaacttcaccagctgctgatggaactcaggtgacaaaatggaatctcttcaaacgaaaatctaaacaaactaccaactttgaaaatccaatctatgcacagatggagaacgagcaaaaggaaagtgttgctgcgacaccacctccatcaccttcgctccctgctaagcctaagcctccttcgagaagagacccaactccaacctattctgcaacagaagacacttttaaagacaccgcaaatcttgttaaagaagactctgaagtatagctataccagctatttagggaataattagaaacacacttttgcacatatattttttacaaacagatgaaaaaagttaacattcagtactttatgaaaaaaatatatttttccctgtttgcctataggtggaggtatcctgtgtgtctttttttacttatgccgtctcatatttttacaaataattatcacaatgtactatatgtatatctttgcactgaagttgtctgaaggtaatactataaatatattgtatatttgtaaattttggaaagattatcctgttactgaatttgctaataaagatgtctgctgaaaaaaaa

SEQ ID NO: 1056 - DNA, 2067 bp, Homo sapiens
ggaattccaatgaatgaatgaatgaatgagtgaatgaatcaacgaaggagtgagtcaaggcccgggaaccacagactccaagcctacgcagagcccgggaagggggattccggaggggcggggcctctttccggaagcgcccgccgggggcggggagggggcggggccatccgcgtgaggcgaccctgttggtccggaggggcggggcgaggaggaggacggccttgggcggttcggctgcccacagtaaccgctgggtggacctggccagcgctccgaaccttgtcctcgctgcgcgccggcccctcggagccccacagcccgggaaggaggcggccgcgggcggggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccgcccccacgcctgccactcccccacgtgggggcgctgagccctcagcagctggaagcactcacttacatctccgaggacggagacacgctggtccacctggcagtgattcatgaggccccagcggtgctgctctgttgcctggctttgctgccccaggaggtcctggacattcaaaataacctttaccagacagcactccatctggctgtacatctggaccaaccgggcgcagttcgggcactggtgctgaagggggccagccgggcactacaggaccggcatggagacacagcccttcatgtggcctgccagcgccagtcttggcctgtgcccgctgcctgctggaagggcgggccagagccaggcagaggaacatctcactctctggacctccagctgcaaaactggcaaggtctggcttgtctccacattgccacccttcagaagaaccaaccactcatggaattgctgcttcggaatggagctgacattgatgtgcaggagggctccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgctgtgtaccgactgaagccaggcagggtctgggatcctcagggctccacctctccatctggaagccggagccataactgctgcagtttgggcccaggctatgtgctcttctggtgccctagggactgctgtggccagagcctggggccagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtccatcttcttgctgttgaggaccctgaaacaccgttgtttaaagacttcacacagaaggctctgaactgagccactggggaagggaagtttcagtaacatgacactaaaatggcagagacgttaaaaaaa

SEQ ID NO: 1057 - DNA, 1474 bp, Homo sapiens
aaaaagaaatcaagaatgcaattttatttacaatagtcacgccggaaatacctagaaataaatttaactgaggatgtaaaagacctctacaaggagagttcaatgcgtagcgggagcggagagctgaccccagagagccctgggcagccccacctccgccgccggcctagttaccatcacaccccggagagcccgcagctgccgcagccggccccagtcaccatcaccgcaaccatgagcagcgaggccgagacccagcagccgcccgccgccccccccgccgcccccgccctcagcgccgccgacaccaagcccggcactaccggagcggcgcagggagcggtggcccgggcggctcacatcggcggcgctggcgcgggcgacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaagccaggcccaacaacgccggccctacgcaggcgaaggttcccaccttactacatgcggagacctatgggcgtcgaccacagtattccaaccctcctgtgcagggagaagtgatggagggtgctgacaaccagggtgcaggagaacaaggtagaccagtgaggcagatatgtatcggggatatagaccacgattccgcaggggccctcctcgccaaaagacagcctagagaggacggcaatgaagaagataaagaaaatcaaggagatgagacccaaggtcagcagccacctcaagctcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatgttttacctaaagacgtctctttttggtaataacaaaccgtgttttttaaaaaagcctggtttttctcaatacgcctttaaaggaattcc

SEQ ID NO: 1058 - DNA, 1394 bp, Homo sapiens
gaccagggcgggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatgcagaaggtgatttactacctctgcatcttattgaaagatccagtggaaccacatgggatatcccaagtagtacccgtcttccagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttgagaaagctatattttccaatagtaccccttgtgtaaagttacgaaaaaaaacaagcccttcagtactggttagcaggaagaaatgtcctacaaaagacgagtctgtcaacctagtgcctgtgttctgtacagggcttatttatttactgttaataaacagatcttccaaaacacacagttacctggttcacagatagctgctttttattgacaaacaagatcatagtatttcagtcatggtgtcaagcacattaatacttttctgttactcagcatttttttttatatcagttcaaaagctacttttgccaagaaggatgagacaaaaggccagacagaaattggactttggttttcagacatgggactctcatgttaacaaagaataaataagcaaatatt

SEQ ID NO: 1059 - DNA, 1600 bp, Homo sapiens
gtccgcaggcttctgcctggccgccgccgcctataagctaccaggaggagctttacgacttcccgtcctgcgggaagtggcgggcacgatcgcaaggtagcgcagaagcttctcaatggccagcgccagctgcagccccggcggcgcactcgcctcacctgagcctgggaggaaaattcttccaaggatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgacacggcgagccatgggcggggcagtgcctttcaaagctgctctcacagagcgcttagccctcatccagccctccagggagcaggtgcagagactcatagcagagcaacccccacacctgacccccggcataagggagctggtaagtcgcctacaggagcgaaatgttcaggttttcctaatatctggtggctttaggagtattgtagagcatgttgcttcaaagctcaatatcccagcaaccaatgtatttgccaataggctgaaattctactttaacggtgaatatgcaggttttgatgagacgcagccaacagctgaatctggtggaaaaggaaaagtgattaaacttttaaaggaaaaatttcattttaagaaaataatcatgattggagatggtgccacagatatggaagcctgtcctcctgctgatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggttttttttttttttgagacagaatcttgctctgttgcccaggctggagtgcagtggcgcggtctcggctcactgcaagctctgcctcccaggttcacgccattctcctgcctcagcctcccgagtagctgggactacaggcgcccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaaaaaaaaaaaaaaaaaaaaaaaaaa

SEQ ID NO: 1060 - DNA, 768 bp, Homo sapiens
ccttcagcataaaagctgatccacaaacaagaggagcaccagacctcctcttggcttcgagatggcttcgccacaccaagagcccaaacctggagacctgattgagattttccgccttggctatgagcactgggccctgtatataggagatggctacgtgatccatctggctcctccaagtgagtaccccggggctggctcctccagtgtcttctcagtcctgagcaacagtgcagaggtgaaacgggggcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcgcccagctgagatatggcaagtcccgctgtaaacaggtggaaaaggccaaggttgaagtcggtgtggccacggcgcttggaatcctggttgttgctggatgctcttttgcgattaggagataccaaaaaaaagcaacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttcaaaaaaaaaaa

SEQ ID NO: 1061 - DNA, 3106 bp, Homo sapiens
ggcggcggctcctgccctctcgctttccctctcgcgtctctggctgcaggtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggagggcagaaatacagatgtggcccagagcccagaggcaccaaagcaagaggctcctgccaagaagaagtctggttcaaagaaaaaagggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcagagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcatggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacaaaaaaaaaaaaaaaaaaaa

SEQ ID NO: 1062 - DNA, 3761 bp, Homo sapiens
gtggcggacgggcggacgcgggccggcggccgctgcggtgccgggagggcggctgggcaggcggcaggaatgctgcgcgccgccctgtccctgctcgcgctgcccctggcgggggcggccgaagagcccacccagaagccagagtccccgggcgagcctcccccaggcttagagctcttccgctggcagtggcacgaggtggaggcgccctacctggtggccctgtggatcctggtggccagtctggccaaaatcgtgtttcacctgtctcggaaagtaacatctctggtccctgagagctgcctgctgattttgctgggcctggtgctagggggaattgttttggctgtggccaagaaagctgagtaccagctggagccaggcaccttcttcctcttcctgctgcctcctattgtgttggactcaggctatttcatgcctagcaggctgttctttgacaacttgggtgccatcctcacctatgccgtggtaggcacactctggaatgccttcacaacaggcgctgccctctggggcttgcagcaggctggacttgtagcccctagggtgcaggctggcttactggacttcctgctgtttgggagcctcatctcggcggtggaccccgtggccgtgctagctgtctttgaggaggtgcacgtcaatgagactctctttatcatcgtctttggcgagtccctgctcaacgatgctgtcaccgtggtgctgtacaaggtctgcaactcctttgtggagatgggctctgccaatgtgcaggccactgactacctgaagggagtcgcctccctgtttgtggtcagtctgggcggggcagccgtgggcttagtctttgccttcctcctggccctgaccacacgcttcaccaagcgggtccgcatcatcgagccgctgctggtcttcctcctcgcctacgcagcctacctcactgctgaaatggcctcgctctccgccattcttgcggtgaccatgtgtggcctgggctgtaagaagtacgtggaggccaacatctcccataagtcacgcacaactgtcaaatatacaatgaagactctagccagctgtgctgagaccgtgatcttcatgctgcttggcatctcagccgtggactcttctaagtgggcctgggattctgggctggtgctgggcaccctcatcttcatcctgttcttccgagccctcggcgtagtcctgcagacctgggtgctgaatcagttccggctagtccctctggacaagattgaccaagtggtgatgtcctatgggggcctgcggggggctgtggcctttgctctcgtcatcctactggataggaccaaggtccctgccaaggactactttgtagccaccactattgtagtggtcttcttcacagtcatcgtgcagggcttgaccatcaagccactggtcaaatggctgaaggtgaagaggagtgagcatcacaaacccaccctgaaccaggagctgcatgaacacacttttgaccacattctggctgcagtggaggacgttgtggggcaccatggctaccactactggagggacaggtgggagcagtttgacaagaaatacctgagtcagctgctgatgcgacgatcagcctaccgcatccgggaccagatctgggatgtgtactacaggcttaacatccgggatgccatcagctttgtggaccagggaggccacgtcttgtcttccacaggtctcactctgccttctatgcccagccgcaattctgtggcagaaacttctgtcaccaacctgctgagggagagtggcagtggagcgtgtctggatctgcaggtgattgacacagtacgcagcggccgggatcgtgaggatgctgtgatgcatcatctgctctgcggaggcctctacaagccgcgccgtaggtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaagaaggatggtgtggcgaatgctgaggctacaaatgggaaacatcgaggcctgggctttcaggacacagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagcttccctgccccaatcctccccagcatggtcatgttcgtggtgtcctggcagtgaagctccgtgagggggctggcccttagaggaactggggtgggaagtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctaaacctttctgatccttgggtctgggttttttgaggaagggacatagtggcctctgggctgccatgtcaccacctgcaacattccccaaacagataagaacccatcatctcagggccactgctccattgctctgggggctgggattcctggctaagcaggggctgacagggtggcaggtgactttctagggatcagcacctgccctgtgttttgtaccttgaacctaagatatattaaacatctctcagatggaaaaaaaaaaaaaaaaaaaa

SEQ ID NO: 1063 - DNA, 4249 bp, Homo sapiens
ccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccgccaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtgggggcacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggaggcagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatctta

SEQ ID NO: 1064 - DNA, 2088 bp, Homo sapiens
catgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagggagagatgattgacaggatcgagtacaatgtggaacacgcggtagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacgcttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtgaccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtatctgtaaaaaaaaaaaaaaaaaagcgttc

SEQ ID NO: 1065 - DNA, 1104 bp, Homo sapiens
ctctagagtcgagatccattgtgctctaaagtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttaaaaaaaaaaaaaaaaaaaaa

SEQ ID NO: 1066 - DNA, 1286 bp, Homo sapiens
gccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacac

SEQ ID NO: 1067 - DNA, 1608 bp, Homo sapiens
gcccccaccatcaaggggaagaaagtgctcttcggattccggttcgccctggcctcccgcagccgccgcgggaccggcccccagcacacccccggggcgccgggcgcggggcagccgcccggacgcgcgcgggcctcaggcgccgccgggaccccagccccccaaactttggcaagttgcgggcgccgagcgcacccggaggcgcggggcgcggccgcaggcggagccgccccctgacgccgggccgccccctcccggccccggccgccccgccggctccgcggaaagtttgcggccgcccctgcgccgcacccggggcctgggtgagactgcggcggcggcagggcgcggacggccatatttgccggcgcggcccgagccgccgacaacaaaaagtgcgcgggcgctcggcgggcgctcggacgggcgcggggctgcagcgctaccgcccggcctcgccgccgccgccgccgccctcgcggcctggccccgccgcgcccggcgcgcccgccgcccggggggatgtcttacaaaccgaacttggccgcgcacatgcccgccgccgccctcaacgccgctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaatttgt

SEQ ID NO: 1068 - DNA, 2433 bp, Homo sapiens
cagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtatcagttgcagctggagagtcggccattctgcactgcactgtgacctccctgatccctgtggggcccatccagtggttcagaggagctggaccagcccgggaattaatctacaatcaaaaagaaggccacttcccccgggtaacaactgtttcagagtccacaaagagagaaaacatggacttttccatcagcatcagtaacatcaccccagcagatgccggcacctactactgtgtgaagttccggaaagggagccctgacacggagtttaagtctggagcaggcactgagctgtctgtgcgtgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctcccccaacattgccacacacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggcaaagagccatgagtcctggaggaggagaggacccctcccaaaggactggaagcaaaaccctctgcttccttgggtccctccaagactccctggggcccaactgtgttgctccacccggacccatctctcccttctagacctgagcttgcccctccagctagcactaagcaacatctcgctgtaagcgcctgtaaattactgtgaaatgtgaaacgtgcaatcttgaaactgaggtgttagaaaacttgatctgtggtgttttgttttgttttttttcttaaaacaacagcaacgtgaaaaaaaaaaaaaaaaa

SEQ ID NO: 1069 - DNA, 2333 bp, Homo sapiens
acgagcagcgacgcccctggtcccacagataccactgcctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttctcccgaatgactgcagctttttttcatgctatggcttcactagccttagtttaataaactgaatgtttggattcctcagttattgtttacttttcatcatggaagcctgtcactgtatgtaggacataatagaacttatcacttgaagctcagcctattggtcttgatcaaatcaaactaagaagaccttagaaataagctaccattttgccacagagcagcttataggtaatacactcttctctcagtgcagtgtacatttccacaaatctaagaattgccctataaacatagcagggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttaggaccttccagtaagtgaaatacaacctagttttatcaccatatccaccagcaggcatccataattattttaacaatgctaatatttgagttttgcagtatattatagaataatatagtccagttaaatctttggtttcagtatgtctgaagagtacagtgagaggttaattttctgctcaagtggtaccacttaaaggcatgtattcttttagtatgtaaaatgaaatagtaccttgagtttaaatagaatgcatttaggcattgtagagatctgaaatagttttcttccactgcgttgttgaaatcaatgaagcaattagtttctcattcagaaatgtgcacactaatatttagttttgctttctcgtggataatattaagcacttactctgcagtttctggaagttgtgtcaactgcagtgatactattcaggatggtgggaaatccccaaaaatatgtatcttttggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttatagggggatt

SEQ ID NO: 1070 - DNA, 1176 bp, Homo sapiens
gccgcggaacagttgcgtctccatctggctaccaacccacccaagctttcttctccaccaccaccaccttccttccttccccctcctccccctcctttccgtcttccctctccacccccgcccccaatctcctcctttttttctcactacgagcggttgctgatgctgaagccgagcgtcacttcggctcccacggcagacatggcgacattgacagtggtccagccgctcaccctggacagagatgttgcaagagcaattgaattactggaaaaactacaggaatctggagaagtaccagtgcacaagctacaatccctcaaaaaagtgcttcagagtgagttttgtacagctattcgagaggtgtatcaatatatgcatgaaacgataactgttaatggctgtcccgaattccgtgcgagggcaacagcaaaggcaacagttgcagcttttgcagctagtgaaggccactcccaccctcgagtagttgaactgccaaagactgatgaaggccttggttttaatgtgatgggaggaaaggagcaaaattcccccatttatatctctcgcataattcctggaggggtggctgaaagacacggaggcctcaaaagaggagaccagctgctatcagtgaacggagtgagtgtggaaggagaacaccatgagaaagctgtggaactactcaaggctgctaaagacagcgtcaagctggtggtgcgatacaccccaaaagttctggaagaaatggaggctcgctttgaaaagctacgaacagccaggcgtcggcagcagcagcaattgctaattcagcagcagcaacagcagcagcagcaacaaacacaacaaaaccacatgtcataggcccttgagggaaagctacttgatcaaacatccgatagtcacaaatttgaaaccgtgcttcagaatcccagcacatagtaaaagacaacactgataattatacctgtcaagaagctgtgaacacatggtgtataaattctttaccaaggcaactcaacaccttctttctctgggcttgaaccgccactgctcacgtgggctttacatacattgaccttccattcactgcagtgggaattctcagtgtgcagagggagaggttttctagtctgcaaactgaaacagtgtaagaagaataaagtctatgacttt

SEQ ID NO: 1071 - DNA, 2645 bp, Homo sapiens
gagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgagtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagatgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtgacttaagtgtgaatttggagtatgcaccatctgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatccaaaaaaaaaaaaaaaa

SEQ ID NO: 1072 - DNA, 1426 bp, Homo sapiens
ggatccgcgtgctaaagaaaaatcgccgttaaagcagttttctttttcactgtctttttcttttcgcggggaacccagctgttcctgcgagggccacctcctcaggaagaccccgcagctctcccgcggcgcttctgcaggaggcagcgacagtttcgagaacccgggccttcccctcccagtgcctccgggggttcgcgtttcaggcgctcgtgttttccgggaagggcaggcgcgctgggccttggggagctgcgctcggcgggcggaccgggggatcatggaagctgataaagatgacacacaacaaattcttaaggagcattcgccagatgaatttataaaagatgaacaaaataagggactaattgatgaaattacaaagaaaaatattcagctaaagaaggagatccaaaagcttgaaacggagttacaagaggctaccaaagaattccagattaaagaggatattcctgaaacaaagatgaaattcttatcagttgaaactcctgagaatgacagccagttgtcaaatatctcctgttcgtttcaagtgagctcgaaagttccttatgagatacaaaaaggacaagcacttatcacctttgaaaaagaagaagttgctcaaaatgtggtaagcatgagtaaacatcatgtacagataaaagatgtaaatctggaggttacggccaagccagttccattaaattcaggagtcagattccaggtttatgtagaagtttctaaaatgaaaatcaatgttactgaaattcctgacacactgcgtgaagatcaaatgagagacaaactagagctgagcttttcaaagttccgaaatggaggcggagaggtggaccgcgtggactatgacagacagtccgggagtgcagtcatcacgtttgtggagattggagtggctgacaagattttgaaaaagaaagaataccctctttatataaatcaaacctgccatagagttactgtttctccatacacagaaatacacttgaaaaagtatcagatattttcaggaacatctaagaggacagtgcttctgacaggaatggaaggcattcaaatggatgaagaaattgtggaggatttaattaacattcactttcaacgggcaaagaatggaggtggagaagtagatgtggtcaagtgttctctaggtcaacctcacatagcatactttgaagaatagacttaacagaatcatgaaaactatagctttttaacccggattactgtaaatgtttgacaagaatgaatatgcttttccttaaaaaatgaaaactttaatttttaccatccatttatgtttagatacaaaacttatttccatgtttctgaatcttctttgtttcaaatggtgctgcatgttttcaactacaataagtgcactgtaataaaaagttttgtttat

SEQ ID NO: 1073 - DNA, 2211 bp, Homo sapiens
ttgggggtttattctcttcccttctaacttgacagggtcttgctctgtcattcaggcaagagtgcagtagtgtgatcacttcttactgccgcctcaagcttccagcctcaactcaagcaatcctcccacctcagccacccaagtggctgggactacagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattggctggagatacagcctcctcttcgtgggcctactacagttaaacattgtcatcttcggagcactgctcagacccatcattatcagaggaccagcgtcaccgaaaatagtcatccaggaaaatcggaaagaagcgcagtatatgcttgaaaatgagaaaacacgaacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggaggactcacattccactgcttgctgaagatgatgtcgtgggcattgcagaagatgtcttctgcagctggggtctacatcttcattcagagcatagcaggactggctggaccgccccttgcaggtttgttggtggaccaaagtaagatctacagcagggccttctactcctgcgcagctggcatggccctggctgctgtgtgcctcgccctggtgagaccgtgtaagatgggactgtgccagcgtcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtc

SEQ ID NO: 1074 - DNA, 1719 bp, Homo sapiens
ccgaattcgggggcagcagccacattggcagtgaggccgtggcagcgtcagcagcagaggatgccccaggccctggagcgtgcagatggcagctgggcctgggtggtgctgctggccaccatggtgacccagggcctcaccctgggcttccccacgtgtatcggcatcttcttcactgaactgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgttaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaattttaaaaaagaaaaaaaaaaaaaaaa

SEQ ID NO: 1075 - DNA, 1530 bp, Homo sapiens
aatcctggaacaaggctacagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggaggttgatgttgaacagcacactttagccaagtatttgatggagctgactctcatcgactatgatatggtgcattatcatccttctaaggtagcagcagctgcttcctgcttgtctcagaaggttctaggacaaggaaaatggaacttaaagcagcagtattacacaggatacacagagaatgaagtattggaagtcatgcagcacatggccaagaatgtggtgaaagtaaatgaaaacttaactaaattcatcgccatcaagaataagtatgcaagcagcaaactcctgaagatcagcatgatccctcagctgaactcaaaagccgtcaaagaccttgcctccccactgataggaaggtcctaggctgccgtgggccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaaggtaaaaaaaaaaaaaaaaaa

SEQ ID NO: 1076 - DNA, 2648 bp, Homo sapiens
ggcacagggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaaaaa

SEQ ID NO: 1077 - DNA, 559 bp, Homo sapiens
ctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaaaaaaaaaaaaaaaaaaaaaaaaaaaaaaaaaaaaaaa

SEQ ID NO: 1078 - DNA, 4366 bp, Homo sapiens
atggaagggggtgcgtacggagcgggcaaagccgggggcgccttcgacccgtacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctgggcgggccaggctgtgctggccttccagcggtaccagattggcgccgactcggccctcttctcccaggactacatggaccccagccaggactccagcatgccttacgcgccctacgtggagcccaacactgggccggatcccgccggtatgggcggcacctaccagcagccggccaacaccttcgacaccgagccccagggctaccagtcgcagggctactgagccacagtgaccgcctgcccccgcccctccccatctgtcccctctctccacacccagcccctgctcctgcccaggctgccctgcccagcgcctcatcagcctctgccttgtcccactgaggtccagggtagctcggggcaggggtggggcagtccagtgttggggactgtctacgtatgtgcaagtatatcccagggcatgtgccccgcaggggcctagagggtgggggccaggggtatttgcattcgtacattgtgtcatcaagcattccttgagcgcctactgggcatccggcctgtgctgggcatgggtggtgacattggcagaaatggccactggaaaggggagcgatgagctgtggaggaagccctggtggtaccagaggccagaatggtgggaaagacagatccagataatgctgggaagtgtggctacaccgtggcttggtcatagggtgagtgtaaacacccacaggacactgggggctgtcaccctgctctggcagtcctgctaagagtgtcaggcccgtctccattttatggttgaggaaactgaggtctagagaggtcaagattacttgcccagaatcactcaggcagctagtgatagaggtggggccaagcccaggctgcccgactgcagaccacgtgctcttccctggccacccacctcctaccatccccacgcttggggcttccctgctcagtgttactgtcattctgggaggccttggggccctcagccccttgagacaccctgattctgctgcatgccaagggcctgttctgccccagctgttcctcctcccctggggacaggcccacctccgggtccctccacccacatccccctggtcctacccctggcccttggcctcctccaagagggctcaccccgggtgctgctctgtgctctgcgtgtcccacagacgcttgttccagggggctccagcaaaccccttcgtggtctctcaaaggactgatcactgtccttgcctctaggaggggtcactaagcccttacctagggctgggtggacaacaaggcacagatgagggtgtgactggcccgaggtcacggtgagtgagtggcaaagctggccctgacgcctgggtttcttggccccagctgcccagcaggtgcctcgattccctgcccttgtgacctcccaggaaacagaactgatctgggacactatgtcacctctcctctcatctggggtcagtcagggttcgggggctgcagcagccaagcgcatgagaggtgtttccttggccttccagaaggcccactgtggagccagcctccctatgggaggcagagcggcaaggacagggctttggaatcagccaggtcggctcctgggctgtggccgtggagagacactgcccccaggatgacacaggcaagagcccctgaggcatgggaggcccagggaagaccatgggctgtaggggagagtgtggcaggtgacccaaaggcccaaagagggccgtggggcctgaggaggtcataatctcttctgagtgggggcaggtcgattcttgcacaaggtgggctcttcactgagccataagggacagggaggtatgggagagcgctgggggcccatccccctgtccacccagtgtccactggcctgtccttcagggagcagagcagagcaggtggtggacgggcccagtgctgggtgttttcaccaccatccccccatcccccatctaagaatcctaagaggcaggcgatccctcacctgcttactcactcagcagttacccggcccctgtgctggagataccaagggcatgggtggtccctgcttcgatggccccaaagctgggccagagttaagggaaagaggaggaagtcctaagcagagaagtagcaccattatccccatttaacagaagggaaactgaggctcggcaagcataggcgagttggcagtggaacacggatctaaactcaggtgtgtccaagtcctcccaaaggacagcagtgatggagaggaccccagccagctgtgtgacagctggttgttgctgacttcattttccaatccggagaaggggctctgtccacagtcccccgccgccaggtggcccacatgggaccagcatgggggcaggttatctgttggcctgaagagtgaaacctgtaccaggccaaaggtgagggcgtgagtgagggcaggagtgtttatggcagagtgaagttctgtgcccaccacaagaggctgtgagatgttctgaccctcacccactgtccaccaaaagcctctcctgctgatgggcactaggagacctcagggtactgcccatctgtttctcctcgggtgccagccagctgctggtgatcctcagccggagggcagggtaccaggtaagcttaactccatcttgggtgtttgtgacaggccctgcctgccaccctaggcagggaaagctgtcaagactcctgccaggaatggggggtgctgagtcatctcacgaagaatccctcactcttcccgggttcagcccagaagcccttccaggcatgatcttccccatcaggctgggctctggcagggacctgcccaggatggagatgagagagggtgagagatggagggcgagatttggatgggacccagggctcctgactctgccctggaaggttcatggggaaactcgctccttctgttggcagaggacagcccctggggaaccccaggcccaactctgtccggtatcccttttcctcccagctgccctcccctacttctcccttgctcccaaagctttccttggagaagggccctcctgcagctggaccctgcagggtggctccctcctccccatcaagcacaagagagggcccaggaaaaaaggtttcacataagtgtagagtcgcaaggacgcttagagtcggcagagtctggggtagggagacagcgacttgtccaaggtcaagcacagagggagaggttcaggagtcaggtcttctgccttctgagttggctcatcctgggcagtcacagactgtcctgcctgcacggctcctatccacctgggggtgtcgcagttgaggggctaattcccaggggactgacgttagttccctactccatccttccctggtgattcttgatcttcaaagcctcggggatcccaggtttccccatgtaactgagacaccctgcctgttagccctgggagacccctaaccttggcccaagacccctttgattctctaaggagcacgaaagggggaatgcccctcccaggagtttatgggagaagggactgggccggctgcctcccagcgatgcacttgacctgacactccccatgtcctggtgcgcacagcccttgtcggtgccccggcccctcccgcagcgttactgcctgtgtatagtataaatatatatattttctatatataagatgtataatataaggctccacaaatatatctgtgtgtgtgtgtgcgtgtgtgtgcggtgaagggcggtccccatcctgggcctccactctagacccccccaccacctggttaagtctcgagtgaatccagtggccccgtggcaccctcctttatgacatccatccatctgtggtgaaccaagtgaaggtggtgacttctggtgacatagtaataaagtgaagactcagaaccca

SEQ ID NO: 1079 - DNA, 2285 bp, Homo sapiens
ccgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggatagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccagatcacagaactgtgtggtgcaaagcgggttggttattttggtccaacacagttttacattgccctgaaattaattgctgcagcacaatctggcctcccggtacggatagagagtattaaatgtgaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacagcaggaaacacagtctcccacgatgtcacccctcgcctcccctccttcttccccgcctcattaccagagggtgcccttgagccatggctacagcaaactgcggagcagcgcagaacagatgcatccagcaccttatgaagctaggcagccccttgtccagcccgagggatcctcatcagggggcccaggaaccaagccccttcggcatcaggcttcccttatccggtccttttcagtggagagggaactacaggataacagcagttaccccgacgaaccctggaggataacagaagaacagcgcgagtactatgtcaatcagttccgatcccttcagccagacccaagctctttcatttcaggttctgtggccaagaacttcttcaccaaatcaaagctttccattccagaactctcctatatatgggagcttagtgatgctgactgtgatggagccctgaccctgcctgagttctgtgctgcgtttcatctcattgtggctcggaagaacggctacccattgcctgagggcctccctccaactctgcagccagaatacctgcaggcagcttttcctaagcccaaatgggactgtcaattatttgattcttattctgagtcactgccggcaaatcaacaacctcgtgacttgaatcggatggagaagacatctgttaaagacatggctgaccttcctgtccctaaccaggatgtaactagtgatgacaaacaagctttgaaaagtactatcaatgaagccttaccaaaggacgtgtctgaggatccagcaactcccaaggattccaacagtctcaaagcaagaccaagatccagatcttactctagcacctccatagaagaggccatgaaaaggggcgaggaccctcccaccccgccacctcggccacagaaaacccattccagagcctcctccttggatctgaataaagtcttccagcccagtgtgccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccata

SEQ ID NO: 1080 - DNA, 2502 bp, Homo sapiens
gaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaagtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagagatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaagccccagtgaaagcagctaccacccctacccggaagagttctagcagtgaggattcctccagtgacgaggaagaggagcaaaaaaaacccatgaaaaataaaccaggtccctacagttacgcccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagcgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgaaaaaaaaaaaggaattc

SEQ ID NO: 1081 - DNA, 1716 bp, Homo sapiens
cgcccagcgacgtgcgggcggcctggcccgcgccctcccgcgcccggcctgcgtcccgcgccctgcgccaccgccgccgagccgcagcccgccgcgcgcccccggcagcgccggccccatgcccgccggccgccggggccccgccgcccaatccgcgcggcggccgccgccgttgctgcccctgctgctgctgctctgcgtcctcggggcgccgcgagccggatcaggagcccacacagctgtgatcagtccccaggatcccacgcttctcatcggctcctccctgctggccacctgctcagtgcacggagacccaccaggagccaccgccgagggcctctactggaccctcaacgggcgccgcctgccccctgagctctcccgtgtactcaacgcctccaccttggctctggccctggccaacctcaatgggtccaggcagcggtcgggggacaacctcgtgtgccacgcccgtgacggcagcatcctggctggctcctgcctctatgttggcctgcccccagagaaacccgtcaacatcagctgctggtccaagaacatgaaggacttgacctgccgctggacgccaggggcccacggggagaccttcctccacaccaactactccctcaagtacaagcttaggtggtatggccaggacaacacatgtgaggagtaccacacagtggggccccactcctgccacatccccaaggacctggctctctttacgccctatgagatctgggtggaggccaccaaccgcctgggctctgcccgctccgatgtactcacgctggatatcctggatgtggtgaccacggaccccccgcccgacgtgcacgtgagccgcgtcgggggcctggaggaccagctgagcgtgcgctgggtgtcgccacccgccctcaaggatttcctctttcaagccaaataccagatccgctaccgagtggaggacagtgtggactggaaggtggtggacgatgtgagcaaccagacctcctgccgcctggccggcctgaaacccggcaccgtgtacttcgtgcaagtgcgctgcaacccctttggcatctatggctccaagaaagccgggatctggagtgagtggagccaccccacagccgcctccactccccgcagtgagcgcccgggcccgggcggcggggcgtgcgaaccgcggggcggagagccgagctcggggccggtgcggcgcgagctcaagcagttcctgggctggctcaagaagcacgcgtactgctccaacctcagcttccgcctctacgaccagtggcgagcctggatgcagaagtcgcacaagacccgcaaccaggacgaggggatcctgccctcgggcagacggggcacggcgagaggtcctgccagataagctgtaggggctcaggccaccctccctgccacgtggagacgcagaggccgaacccaaactggggccacctctgtaccctcacttcagggcacctgagccaccctcagcaggagctggggtggcccctgagctccaacggccataacagctctgactcccacgtgaggccacctttgggtgcaccccagtgggtgtgtgtgtgtgtgtgagggttggttgagttgcctagaacccctgccagggctgggggtgagaaggggagtcattactccccattacctagggcccctccaaaagagtccttttaaataaatgagctatttaggtgc

SEQ ID NO: 1082 - DNA, 2334 bp, Homo sapiens
atgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctga

SEQ ID NO: 1083 - DNA, 3311 bp, Homo sapiens
gcgagcgggggcgcgggtggcgcggcgggacgcgagcggcgagccggagcgcgagcccgctcccgcaccatggaggaggacgacagctacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggaggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctattttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtcttggcgagatggacaggtgaggtcgaggacgcagagggcagaggcccagtggagcctcagacggcacagtcagagtcgggggcctgcctggccggggtcgcagtcggcagcagcgtgcagtccggcatctcccgcggatgcttttccatcccaagtgcctgcggagcccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagcttcagctttttctgcctcaaaaccagccctaactggactactctggatgcattttgtggtgggccccctagagggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccccgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagcaaaaaaaaaa

SEQ ID NO: 1084 - DNA, 2036 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtccccccccccacctttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaactgtctg

SEQ ID NO: 1085 - DNA, 1174 bp, Homo sapiens
gcctgtccaccatctccctattaccctttggtcgagagggaaagcagaagaagtctgctggtcacacgggggcacctcgaggagaggacgactaggagcacacggcccggaaaggtccaggtcagggaagggaataactgtgcttgaagaagaaaattcccaacatggacaaaccacgcaaagaaaatgaagaagagccgcagagccgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggactccctccgcaggtctttccaggaaggacctgtttgaggttcgccctcccatggagcagcctccttgtggagtaggaaaacataaccttgaagaaggaatctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggagggcaaaacggggcggtccttatcctatttaatgtgttcggcctttaattctgttttgcctgctatagtattgccattgccacctggactttctgtttgcattttcttaatgccttttccctatttctgaattttaactttttgtgaggctttattttagatgtttagcatgtaactcgcttaaagttgaggtttccccctaaaatctacaagtttccctctttcagtcatgagccctacacatttgcatgaaagatgtacatatatattgtgaacgaaaaaagcaattttcaaatggtatatatgtatcccattttgtaaaaaatgtatattatatattaatatgcaaagaaaaagctaaaagtatagacttcaaaggcataacagtggttgtgtggtaagatataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagg

SEQ ID NO: 1086 - DNA, 2498 bp, Homo sapiens
accagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacatataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcagactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtgtactctcactttaaactcaccaaagaagattctcttaaagaaattatgaaaaatgtacaatttaacattttaaataaatagtgacagaagttgtttaaaaa

SEQ ID NO: 1087 - DNA, 4724 bp, Homo sapiens
atccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatacagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcgaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctggcactttgggaggccgaggtgggtggaccacctgaggttaggacttcgagaccagcctggccaacatggtggaaccccgtctgtactaaaagtgcaaaggtttgcctggtgtggtggtgcatgcctctagtcctggctactcgggaggctgaggcacgagaatcgcttgggcctgggaggcggaggttgcagtgagtcgagataacactactgcattccagcctgggtgacagagtgagactccacctc

SEQ ID NO: 1088 - DNA, 2838 bp, Homo sapiens
ctccggcccggccccgagcaccgcctccccagccagcgccgccgcgatggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaaaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaaggttggactagtactacaatagatggatatttttatttctagaactctgacatcatcatttgttaatatttaatgatttctggaactgccattccaaagaagaataaaagcacaactcaagtgaaattgaagtagtcgataatcagaaaagatgacaaaagtccacatgtgacatttgtacgtttctagctagaatgttaaacttcatcctttttttactgttgacctatttgtgggagggatgaaaggctacaaagagcacattcttgtaattttcaaatttttgcctgtctcttgaagaggtattttttcacccttagaaaagggactgtttttctatggactaagtagaagttacagagtcatgtaagaaaatctttgctattgtgtggagagaaattgctgcatttctgtttcttaagtgatggtacatttgtccatgtaacagaacaaaagatccatttggaaattttttttactggtatcaccttacatggtatcactgggaacatttatggaatcaacacttctgtagctcagtgacaggtggtggttgtttaagtgcagagcaatattaaatgtactggtgactagtacatgtatttctccataagcagagttgccgaatcaataaacatgcaagtttgtactttgatctttaccaggtcagtggattgcttcaaaagcagagttttgtgcaagcactcactgtgctctctgaaagagcctgaggccgggcgtggtggctcacgcctgtaatcccagcactttgggaggccaaggtgggcagatcatgaggtcaggagatcgagaccattctggccaacatagtgaaaccccatctctactaaaaatacaaaaattagccgggcgtggtggcgtgtgcctgtagtcccagctgcttgggaggctgaggcaggagaatcgcttgaacctgagaggtgaggttgcagtgagccgagatcgagccactgcactccagcctgggtgacagagcgtgagactccgtctcaaaaaaaaaaaaaaaagaaagagcctgtacccgcgactaactagacttttcttgctgttgtgcaaagttcagtttcttctcagcaacatcaaggatatatgaagaaaaggaaataaaaaactgtaaagtcaaaagagatgcctggtggaacttattcgtgctatcagggcattgatagtttgaatgtttttattacttatgcaaaattgcacatactcctctatgctgattttatcatgaaaactgtcatgtgtcatgctaatggaaaatgtcttatttgtaaataagtattcataattttgccg

SEQ ID NO: 1089 - DNA, 1875 bp, Homo sapiens
aaagcatccagttcctttgcggtcctcttcttcagcacatgccaaagctgttcctcacggcctgtgagacaagagcatcttggatgtaggacaatggaagagttagatgccttattggaggaactggaacgctccacccttcaggacagtgatgaatattccaacccagctcctcttcccctggatcagcattccagaaaggagactaaccttgatgagacttcggagatcctttctattcaggataacacaagtcccttgccggcgcagctcgtgtatactaccaatatccaggagctcaatgtctacagtgaagcccaagagccaaaggaatcaccaccaccttctaaaacgtcagcagctgctcagttggatgagctcatggctcacctgactgagatgcaggccaaggttgcagtgagagcagatgctggcaagaagcacttaccagacaagcaggatcacaaggcctccctggactcaatgcttgggggtctggagcaggaattgcaggaccttggcattgccacagtgcccaagggccattgtgcatcctgccagaaaccgattgctgggaaggtgatccatgctctagggcaatcatggcatcctgagcattttgtctgtactcattgcaaagaagagattggctccagtcccttctttgagcggagtggcttggcctactgccccaacgactaccaccaacttttttctccacgctgtgcttactgcgctgctcccatcctggataaagtgctgacagcaatgaaccagacctggcacccagagcacttcttctgctctcactgcggagaggtgtttggtgcagaaggctttcatgagaaggacaagaagccatattgccgaaaggatttcttagccatgttctcacccaagtgtggtggctgcaatcgcccagtgttggaaaactacctttcagccatggacactgtctggcacccagagtgctttgtttgtggggactgcttcaccagtttttctactggctccttctttgaactggatggacgtccattctgtgagctccattaccatcaccgccggggaacgctctgccatgggtgtgggcagcccatcactggccgttgtatcagtgccatggggtacaagttccatcctgagcactttgtgtgtgctttctgcctgacacagttgtcgaagggcattttcagggagcagaatgacaagacctattgtcaaccttgcttcaataagctcttcccactgtaatgccaactgatccatagcctcttcagattccttataaaatttaaaccaagagaggagaggaaagggtaaattttctgttactgaccttctgcttaatagtcttatagaaaaaggaaaggtgatgagcaaataaaggaacttctagactttacatgactaggctgataatcttattttttaggcttctatacagttaattctataaattctctttctccctctcttctccaatcaagcacttggagttagatctaggtccttctatctcgtccctctacagatgtattttccacttgcataattcatgccaacactggttttcttaggtttctccattttcacctctagtgatggccctactcatatcttctctaatttggtcctgatacttgtttcttttcacgttttcccatttgccctgtggctcactgtcttacaatcactgctgtggaatcatgataccacttttagctctttgcatcttccttcagtgtatttttgtttttcaagaggaagtagattttaactggacaactttgagtactgacatcattgataaataaactggcttgtggtttcaataaaaaaaaaaaaaaaaaaaaaaaaaaaaaaaaaaaaaaa

SEQ ID NO: 1090 - DNA, 1485 bp, Homo sapiens
tcagccaattagagctccagttgtcactcctacccacactgggcctgggggtgaagggaagtgtttattaggggtacatgtgaagccgtccagaagtgtcagagtctttgtagctttgaaagtcacctaggttatttgggcatgctctcctgagtcctctgctagttaagctctctgaaaagaaggtggcagacccggtttgctgatcgccccagggatcaggaggctgatcccaaagttgtcagatggagagtaaatacaaggagatactcttgctaacaggcctggataacatcactgatgaggaactggataggtttaagttctttctttcagacgagtttaatattgccacaggcaaactacatactgcaaacagaatacaagtagctaccttgatgattcaaaatgctggggcggtgtctgcagtgatgaagaccattcgtatttttcagaagttgaattatatgcttttggcaaaacgtcttcaggaggagaaggagaaagttgataagcaatacaaatcggtaacaaaaccaaagccactaagtcaagctgaaatgagtcctgctgcatctgcagccatcagaaatgatgtcgcaaagcaacgtgctgcaccaaaagtctctcctcatgttaagcctgaacagaaacagatggtggcccagcaggaatctatcagagaagggtttcagaagcgctgtttgccagttatggtactgaaagcaaagaagcccttcacgtttgagacccaagaaggcaagcaggagatgtttcatgctacagtggctacagaaaaggaattcttctttgtaaaagtttttaatacactgctgaaagataaattcattccaaagagaataattataatagcaagatattatcggcacagtggtttcttagaggtaaatagcgcctcacgtgtgttagatgctgaatctgaccaaaaggttaatgtcccgctgaacattatcagaaaagctggtgaaaccccgaagatcaacacgcttcaaactcagccccttggaacaattgtgaatggtttgtttgtagtccagaaggtaacagaaaagaagaaaaacatattatttgacctaagtgacaacactgggaaaatggaagtactgggggttagaaacgaggacacaatgaaatgtaaggaaggagataaggttcgacttacattcttcacactgtcaaaaaatggagaaaaactacagctgacatctggagttcatagcaccataaaggttattaaggccaaaaaaaaaacatagagaagtaaaaaggaccaattcaagccaactggtctaagcagcatttaattgaagaatatgtgatacagcctcttcaatcagattgtaagttacctgaaagctgcagttcacaggctcctctctccaccaaattaggatagaataattgctggataaacaaattcagaatatcaacagatgatcacaataaacatctgtttctcattcc

SEQ ID NO: 1091 - DNA, 2321 bp, Homo sapiens
attcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcggatgaagaaaatgaatcacaagtcaactgacagtccaaaggctccacagctcagaggaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcctcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgc

SEQ ID NO: 1092 - DNA, 2663 bp, Homo sapiens
acgaggcggaggcggcctgccggggtggttcggcttcccgttgccgcctcgggcgctgtacccagagctcgaagaggagcagcgcggccgcgcggacccggcaaggctgggccggactcggggctcccgagggacgccatgcggggaggcaggggcgcccctttctggctgtggccgctgcccaagctggcgctgctgcctctgttgtgggtgcttttccagcggacgcgtccccagggcagcgccgggccactgcagtgctacggagttggacccttgggcgacttgaactgctcgtgggagcctcttggggacctgggagccccctccgagttacacctccagagccaaaagtaccgttccaacaaaacccagactgtggcagtggcagccggacggagctgggtggccattcctcgggaacagctcaccatgtctgacaaactccttgtctggggcactaaggcaggccagcctctctggccccccgtcttcgtgaacctagaaacccaaatgaagccaaacgccccccggctgggccctgacgtggacttttccgaggatgaccccctggaggccactgtccattgggccccacctacatggccatctcataaagttctgatctgccagttccactaccgaagatgtcaggaggcggcctggaccctgctggaaccggagctgaagaccatacccctgacccctgttgagatccaagatttggagctagccactggctacaaagtgtatggccgctgccggatggagaaagaagaggatttgtggggcgagtggagccccattttgtccttccagacaccgccttctgctccaaaagatgtgtgggtatcagggaacctctgtgggacgcctggaggagaggaacctttgcttctatggaaggccccagggccctgtgtgcaggtgagctacaaagtctggttctgggttggaggtcgtgagctgagtccagaaggaattacctgctgctgctccctaattcccagtggggcggagtgggccagggtgtccgctgtcaacgccacaagctgggagcctctcaccaacctctctttggtctgcttggattcagcctctgccccccgtagcgtggcagtcagcagcatcgctgggagcacggagctactggtgacctggcaaccggggcctggggaaccactggagcatgtagtggactgggctcgagatggggaccccctggagaaactcaactgggtccggcttccccctgggaacctcagtgctctgttaccagggaatttcactgtcggggtcccctatcgaatcactgtgaccgcagtctctgcttcaggcttggcctctgcatcctccgtctgggggttcagggaggaattagcacccctagtggggccaacgctttggcgactccaagatgcccctccagggacccccgccatagcgtggggagaggtcccaaggcaccagcttcgaggccacctcacccactacaccttgtgtgcacagagtggaaccagcccctccgtctgcatgaatgtgagtggcaacacacagagtgtcaccctgcctgaccttccttggggtccctgtgagctgtgggtgacagcatctaccatcgctggacagggccctcctggtcccatcctccggcttcatctaccagataacaccctgaggtggaaagttctgccaggcatcctattcttgtggggcttgttcctgttggggtgtggcctgagcctggccacctctggaaggtgctaccacctaaggcacaaagtgctgccccgctgggtctgggagaaagttcctgatcctgccaacagcagttcaggccagccccacatggagcaagtacctgaggcccagccccttggggacttgcccatcctggaagtggaggagatggagcccccgccggttatggagtcctcccagcccgcccaggccaccgccccgcttgactctgggtatgagaagcacttcctgcccacacctgaggagctgggccttctggggccccccaggccacaggttctggcctgaaccacacgtctggctgggggctgccagccaggctagagggatgctcatgcaggttgcaccccagtcctggattagccctcttgatggatgaagacactgaggactcagagaggctgagtcacttacctgaggacacccagccaggcagagctgggattgaaggacccctatagagaagggcttggcccccatggggaagacacggatggaaggtggagcaaaggaaaatacatgaaattgagagtggcagctgcctgccaaaatctgttccgctgtaacagaactgaatttggaccccagcacagtggctcacgcctgtaatcccagcactttggcaggccaaggtggaaggatcacttagagctaggagtttgagaccagcctgggcaatatagcaagacccctcactacaaaaataaaacatcaaaaacaaaaacaattagctgggcatgatggcacacacctgtagtccgagccacttgggaggctgaggtgggaggatcggttgagcccaggagttcgaagctgcagggacctctgattgcaccactgcactccaggctgggtaacagaatgagaccttatctcaaaaataaacaaactaataaaaagca

SEQ ID NO: 1093 - DNA, 1363 bp, Homo sapiens
gaggaaaagctttcggactgctgaaggcccagcaggaagagaggctggatgagatcaacaagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcactcacccagagaaatacatggagtttgaccttaatggaaatggcgatattggtgagaaacgggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 1094 - DNA, 2366 bp, Homo sapiens
gaccacgcgtatcgatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatggggcccagggcagtgacgtggatgtcttggtttgtcagcggctgagtgaccaggctggggaagatgaggaggaagagtgcaaagaggaggcagagacccagagcgggtcctgctgcccttccacttccctggcagtttcgtggaggagatgagtgacagccggcgctacagcctggcagatctgactgcccagttttcaatgccttgtgaggtcaaggtggtggccaaggacaccagccaccccaatgaccctcagaacctccttcctgggcctgcggctggaggagaagatcacagagccattcttggtggtgagcctggactctgagctgggatgtgctttgagatccctccccggaggctggacctgactgtcgtggaggccaaggggcagccagacttgccagaggggtctctccccatagccacagtggaggaagctggaacagacaccttttattattgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgttcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcc

SEQ ID NO: 1095 - DNA, 1204 bp, Homo sapiens
cggaacgagggcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaagcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggacgactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggagccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggaggcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttaaaaaaaaaaa

SEQ ID NO: 1096 - DNA, 1283 bp, Homo sapiens
ggccgcctcgcacccggaacaacaaagcaaggaagacggagcgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggattggactcaaaaggaaaactggaccaacaaaagataaaaaaaaaaaaaaaaaaaaa

SEQ ID NO: 1097 - DNA, 1926 bp, Homo sapiens
ggggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaagaagaactagaaagaaaagccgcagaattagatcgtcgggaacgagaaatgcaaaacctcagtcaacatggtagaaaaaatatttggccacctcttcctagcaattttcctgtcggaccttgtttctatcaggaattttctgtagacattcctgtagaattccaaaagacagtaaagcttatgtactacttgtggatgttccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcaggagtgacagttcatttagattctttgtattcttcttcgtctatatttgtcagtttgctgtacatgtactccaagctgcaggatttcataactggggcaattgtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattccttttt

SEQ ID NO: 1098 - DNA, 561 bp, Homo sapiens
aatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaggtgactggggacttggaaccctaggacctgaacaaccaagactttaaataattttaaatgcaaaaactcagaaaaaaaaaaaaaaa

SEQ ID NO: 1099 - DNA, 1008 bp, Homo sapiens
gcaattctagccttggtacaaattcgatgaaaattatgcattcctgcaccgcacgctaaaggagattctcagatacctgatggatccagacacattcactttcaactttaataatgaccctttggtccttcgacggcgccagacctacttgtgctatgaggtggagcgcctggacaatggctggatggtcctgatggaccagcacatgggctttctatgcaacgaggctaagaatcttctctgtggcttttacggccgccatgcggactggcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgccgatcttcgctgcccgcatctatgattatgaccccctatataaggaggcgctgcaaatgctgcgggatgctggggcccaagtctccatcatgacctacgatgagtttgagtactgctgggacacctttgtgtaccgccagggatgtcccttccagccctgggatggactagaggagcacagccaagccctgagtgggaggctgcgggccattctccagaatcagggaaactgaaggatgggcctcagtctctaaggaaggcagagacctgggttgagcagcagaataaaagatcttcttccaagaaatgcaaacgagccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacactaaaaaaaaaaaaaaaaaaaaaaa

SEQ ID NO: 1100 - DNA, 1622 bp, Homo sapiens
ggccggcggcagagctgtccggctgcgcggtggcccggggggcccgggcggcagggcaagcagcgcggcctcggcctatgcgaccggtggcgccggcgcggcttctgcctggagaggattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgcctt

SEQ ID NO: 1101 - DNA, 4211 bp, Homo sapiens
cgcgggcggcggtgctaggctcgcctctgcctccctcgtggcgggcccggacatggggtcccgtggcctgagtccctcggccggcgcgcagggctcggggccgcgcgcaccttccccgcactgactgtcgcgccgtgccctgcgccaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgcgcagtccacgccctcttccttatcctgcacagcggcaacatcctggactcaggccctggagacgccaactccaagcaggcggatgtgcagacgctgagctccgccttcgaggccgtcacccgcatccacttccctgaggccttgggccacgtggcgctgcgactggtgccctgtccacccatctgcgccgccgcctatgcccttgtctccaacctgagcccttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcgcactgattggagatggtgttggtggcatcctgggctttgatgcactctgccacagtgctaacgcgggcaccgggagtcggggcagcagccgccgtgggagcatgaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacagccttcaggcagcccccgcaaccacctcctcctgggagccccggcgggcaagcacggccttctgcccacccgctgccagttccgaggcacctgacggccccagcagcactgcccgccttgacttcaaggtctctggcttcttcctcttcggctccccactgggcctggtgctggctctgcgcaaaactgtgatgcccgccctggaggcagcccagatgcgcccagcctgtgaacagatctacaacctcttccacgcggccgacccctgcgcctcacgcctcgagcccctgctggccccgaagttccaggccatcgccccactgaccgtgccccgctaccagaagttccccctgggagatggctcatccctgctgctggccgacactctgcagacgcactccagcctctttctggaggagctggagatgctggtgccctcaacacccacctctactagcggtgccttctggaagggcagtgagttggccactgaccccccggcccagccagccgcccccagcaccaccagtgaggtggttaagatcctggagcgctggtgggggaccaagcggatcgactactcgctgtactgccccgaggcgctcaccgcctttcccaccgtcacgctgccccacctcttccacgccagctactgggagtccgccgacgtggtggcgttcatcctgcgccaggtgatcgagaaggagcggccacagctggcggaatgcgaggagccgtccatctacagcccggccttccccagggagaagtggcagcgaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaatagctcgggccgcctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggcactggcaggactccggctacctgatcgtgtatgtcacaggccggccggatatgcagaagcaccgcgtggtggcatggctgtcgcagcacaacttcccccacggcgtcgtctccttctgcgacggcctcacccacgacccactacgccagaaggcaatgtttctccagagcctggttcaggaggtaggactgaacatcgtggccggttatgggtctcccaaagatgtggctgtatacacggcgctggggctgtccccgagccagacctacatcgtgggccgtgccgtgcggaagctacaggcgcagtgccagttcctgtcagacggctatgtggcccacctgggccagctggaagcgggctcgcactcgcatgcctcctcgggacccccgagagctgccttgggcaagagcagctatggtgtggctgcccccgtggacttcctgcgcaaacagagccagctgcttcgctcgaggggccccagccaggcggagcgtgagggcccgggaacaccacccaccaccctggcacggggcaaagcacggagcatcagcctgaagctggacagcgaggagtgaggcccacaccagcctggacctgggttatttattgacacacccaaggggcccgaggggctgcgtgtgggaggctggggacccagacttttggccccagcgctggcccccccagccccacaccctatatctccgtgtgctcctcggtgttacttccctttcatatgaggggacccagcgccggggggagggaggagggcgtgggcatgggcgcagaggcttttccagtgtgtataaatccatgaaaataaacgccacctgcaccccaaaaaaaaaaaaaaaaaaaaaaa

SEQ ID NO: 1102 - DNA, 2864 bp, Homo sapiens
ccagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccaccggaggccggcaacaaacgacagtatctcggattcctttttttttttttttaattttttatactttgttgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttaaaaaaaaaaaaaaaaaaaaaaaaaaaaaaaaaaaaagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagctgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaataattctctgtacaggggggtttgtgctatacactgggatgtctaattgcagcaataaagcctttctt

SEQ ID NO: 1103 - DNA, 1152 bp, Homo sapiens
gaggcgggtcccggttgcagacttgccatggcctccgaagcttctgtgcgtctaggggtgccccctggccgtctgtggatccagaggcctggcatctacgaagatgaggaggggagaacctgggtgactgtggtcgtgcggttcaatccctcgcgtagggaatgggccagggcctcccagggcagcagatatgaacccagcatcacagtgcacttgtggcagatggcagtgcatacccgggagctactctcctccggccagatgcccttctcccagctgcccgccgtgtggcagctctaccccgggaggaagtaccgagcagcggattccagtttctgggaaatagcagaccatggccagattgactctatggagcagctggtcctaacatatcagccggagaggaaagactgacactgggagtggctggccctgctggccctgcctcttctggcctggtgtctcctcatgccccctcagtgaggatcttcatgtacctgctcttctgtttgcacacccagcatagcctccttgcaggcagaaggcagtagggcccctgcacactcagtttctctcgttttccttagttatcagtcctgtcctgtcccactcaggtctgtacttagggcagctggcctggatgggcttcactggggccctgtctgtgtgctgagccagtttcccctgctggctgcaagctgtgggttctttctcctctgtgcccctcatgctgatcttctagatgccactcccaaatccccttcatacccaccaggatgtgtgcccagccaggcctccagcacccccagtgcagctcgtgattggaaactcaccatcggcaggcagtggttcggtttaagagatggcattagagggagcccagtctggatgtggacttggatgccctgtgggtatcagttctgctgacactttggcccgaaatagatccagtgctgagcaagcaatgtacaccggagcctcagtgagcccatctgcacagtggggagcatggagggatgggtttggcctgtgcttctgcttattcagtccttcagctcacggaagggatgctagtccgtgaaggtgacctcacagtactggttaattaaactttattgctcactgtcaaaaaaaaaaaaaaaaaaaaaaaaa

SEQ ID NO: 1104 - DNA, 2134 bp, Homo sapiens
aattcggggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccgcgggtgttttgcccctggggcgcctgggtcctgcgaaggagcctcccacccgggcgtccgcatgatcccagttgaaatcaaggtaagcaggtggtactactacaagtaataatccggaagaagcaactttgcagaatcttcttgctcaggaatcctgttgcaagttcccatggtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcagatgtccctaaaccaatgactgctttagtagggagatttttgccagcatcaacaaaattaaatctcattacacaacaacttgagggagccttaccatcggtagtcaacgggtctgctttcccctcgggatcaactcttccaggaccaccaaaaataactttggctgggtactgtgactgctttgccagtggggacttttgcaacaactgcaattgtaataattgttgcaacaacttgcatcatgatattgaacggtttaaagccattaaggcatgtcttggtagaaatccagaagctttccagccaaaaattgggaagggccaattgggcaatgtcaagccccagcacaacaaagggtgcaactgcaggaggtcaggctgcctgaagaattactgcgagtgctatgaggcccaaattatgtgttcttctatttgcaaatgcattggttgcaaaaattatgaagaaagcccagaacgaaagacactaatgagcatgccaaactacatgcagactggaggtttggaaggcagccattacctgccaccaacgaaattttcaggacttccaagattcagtcacgataggcggccttcctcatgcatctcctgggaggtggtggaggccacatgcgcctgcctgcttgctcagggagaagaggccgagaaagaacactgctccaagtgcctggcagagcagatgatcctggaggaatttggaaggtgcttatcacagattctccacactgagtttaaatctaagggattgaaaatggagtagagtataaagtgtgaatgcatgttgattttgtcttagtctagaaatctctagtttagaaaggatgtttaggggaacatgaggctggctctgcagcaacaaccaggctcccctgcatccctgggcccagggagtttactcagagctctctgaagatgtggcaacccatgcccccttttctgaggaggtgcatggcctgagcattgtttgtctggcccagaggagagagcttgggttcccatagtcctgggagagtgtctgcagggcggcggagggcagagcaggccctgcggagagctcactctggtcgactcttcctctcagagaatgttgctctggaggctgctctgcatgaaaaccctaatggtttcttgtttgtttttcaaattatttagaaataagttctccggatgggctgttgtgataccacttaaaatctctagagaactactgaacacctaaagattttctgtagcgtagatatttccccagagacacgcgaactgtcagtctttctaaggccccccgggagacgcaggcaatggggcctcgcaggccaggcttgcaccagcatgtcttgagttagaggacttaaaattatccagtttcttctgtgtttctacttgaattgtggaaaagctctattatccaattaacttctccataattattgttgtaatattattattgtttgtaaaacatggttcacataactagcttgtggaaaccagcaggtaaaatgaattcttaagttgacgcttttggttctgttgtaaagcaaagatgaataaaaatttccaatgtcgaaaaaaaaaaaaaaaaaaaaaaaaa

SEQ ID NO: 1105 - DNA, 5910 bp, Homo sapiens
cggaggacagccggaccgagccaacgccggggactttgttccctccacggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgaggggcctacggaggcgcaggagcggtggtgatggtctgggaagcggagctgaagtcccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagtaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcaagttacttgtgcagcttcggctcaaatcccaatatccaggacaaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaacccagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgtggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccaataacggggctcccaaggatttcctccccagccccctccacgccctgctgcgggaatggaccacctaccctgagagcacagtgggcaccctcatgtccaaactgagggagctgggtcgccgggatgccgcagaccttttgctgaaggcatcctctgtgttcaaaatcaacctggatggcaatggccaggaggcctatgcctcgagctgcaacagcggcacctcttacaattccattagctctgttgtatcccggtgagggcagcctctggcttggacagggtctgtttggactgcagaaccaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactatcatattgattgtcctttaaaaaagaaaagtgcatatttatccaaaatgtgtatttcttatacgcttttctgtgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttaaaaaaaaaaaaaa

SEQ ID NO: 1106 - DNA, 1643 bp, Homo sapiens
ggaattccctgatatacacctggaccaccaccaatggatatacaaatggcaaacaattttactccgccctctgcaactcctcagggaaatgactgtgacctctatgcacatcacagcacggccaggatagtaatgcctctgcattacagcctcgtcttcatcattgggctcgtgggaaacttactagccttggtcgtcattgttcaaaacaggaaaaaaatcaactctaccaccctctattcaacaaatttggtgatttctgatatactttttaccacggctttgcctacacgaatagcctactatgcaatgggctttgactggagaatcggagatgccttgtgtaggataactgcgctagtgttttacatcaacacatatgcaggtgtgaactttatgacctgcctgagtattgaccgcttcattgctgtggtgcaccctctacgctacaacaagataaaaaggattgaacatgcaaaaggcgtgtgcatatttgtctggattctagtatttgctcagacactcccactcctcatcaaccctatgtcaaagcaggaggctgaaaggattacatgcatggagtatccaaactttgaagaaactaaatctcttccctggattctgcttggggcatgtttcataggatatgtacttccacttataatcattctcatctgctattctcagatctgctgcaaactcttcagaactgccaaacaaaacccactcactgagaaatctggtgtaaacaaaaaggctctcaacacaattattcttattattgttgtgtttgttctctgtttcacaccttaccatgttgcaattattcaacatatgattaagaagcttcgtttctctaatttcctggaatgtagccaaagacattcgttccagatttctctgcactttacagtatgcctgatgaacttcaattgctgcatggacccttttatctacttctttgcatgtaaagggtataagagaaaggttatgaggatgctgaaacggcaagtcagtgtatcgatttctagtgctgtgaagtcagcccctgaagaaaattcacgtgaaatgacagaaacgcagatgatgatacattccaagtcttcaaatggaaagtgaaatggattgtattttggtttatagtgacgtaaactgtatgacaaactttgcaggacttcccttataaagcaaaataattgttcagcttccaattagtattcttttatatttctttcattgggcgctttcccatctccaactcggaagtaagcccaagagaacaacataaagcaaacaacataaagcacaataaaaatgcaaataaatattttcatttttatttgtaaacgaatacaccaaaaggaggcgctcttaataactcccaatgtaaaaagttttgttttaataaaaaattaattattattcttgccaacaaatggctagaaaggactgaatagattatatattgccagatgttaatactgtaacatactttttaaataacatatttcttaaatccaaatttctctcaatgttagatttaattccctcaataacaccaatgttttgttttgtttcgttctgggtcataaaactttgttaaggaactcttttggaataaagagcaggatgctgcggaattc

SEQ ID NO: 1107 - DNA, 1427 bp, Homo sapiens
attaacccaggagatgggggtcgaggagagaccccggggagtagagagagagaaactcactccccgagtccccgaccctccccaagcaaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataaaaaaaaaaaa

SEQ ID NO: 1108 - DNA, 2334 bp, Homo sapiens
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagccgctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttgcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaaccttt

SEQ ID NO: 1109 - DNA, 5212 bp, Homo sapiens
cttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaaatgatggaacaagacccaaaatgacaccggaacaaatggccaaagaaatgtcagaatttttgagtagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacactagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagt

SEQ ID NO: 1110 - DNA, 531 bp, Homo sapiens
ggcccttcagtatgcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaaaaaaaaaaaaaaaaaaa

SEQ ID NO: 1111 - DNA, 1134 bp, Homo sapiens
atggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttag

SEQ ID NO: 1112 - DNA, 3358 bp, Homo sapiens
gagctggagcagccgccaccgccgccgccgagggagccccgggacggcagcccctgggcgcagggtgcgctgttctcggagtccgacccagggcgactcacgcccactggtgcgacccggacagcctgggactgacccgccggcccaggcgaggctgcagccagagggctgggaagggatcgcgctcgcggcatccagaggcggccaggcggaggcgagggagcaggttagagggacaaagagctttgcagacgtccccggcgtcctgcgagcgccagcggccgggacgaggcggccgggagcccgggaagagcccgtggatgttctgcgcgcggcctgggagccgccgccgccgccgcctcagcgagaggaggaatgcaccggccgcgccgccgcgggacgcgcccgccgctcctggcgctgctggccgcgctgctgctggccgcacgcggggctgctgcccaagaaacagagctgtcagtcagtgctgaattagtgcctacctcatcatggaacatctcaagtgaactcaacaaagattcttacctgacccttgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggcccccctcccactgcaagtccaggatactcagatgagtatgaagaagatggattctgtcagccatacagagggattgcatgtgcaagatttattggcaaccgcaccgtctatatggagtctttgcacatgcaaggggaaatagaaaatcagatcacagctgccttcactatgattggcacttccagtcacttatctgataagtgttctcagttcgccattccttccctgtgccactatgccttcccgtactgcgatgaaacttcatccgtcccaaagccccgtgacttgtgtcgcgatgaatgtgaaatcctggagaatgtcctgtgtcaaacagagtacatttttgcaagatcaaatcccatgattctgatgaggctgaaactgccaaactgtgaagatctcccccagccagagagcccagaagctgcgaactgtatccggattggaattcccatggcagatcctataaataaaaatcacaagtgttataacagcacaggtgtggactaccgggggaccgtcagtgtgaccaaatcagggcgccagtgccagccatggaattcccagtatccccacacacacactttcaccgcccttcgtttcccagagctgaatggaggccattcctactgccgcaacccagggaatcaaaaggaagctccctggtgcttcaccttggatgaaaactttaagtctgatctgtgtgacatcccagcttgcgattcaaaggattccaaggagaagaataaaatggaaatcctgtacatactagtgccaagtgtggccattcccctggccattgctttactcttcttcttcatttgcgtctgtcggaataaccagaagtcatcgtcggcaccagtccagaggcaaccaaaacacgtcagaggtcaaaatgtggagatgtcaatgctgaatgcatataaacccaagagcaaggctaaagagctacctctttctgctgtacgctttatggaagaattgggtgagtgtgcctttggaaaaatctataaaggccatctctatctcccaggcatggaccatgctcagctggttgctatcaagaccttgaaagactataacaacccccagcaatggatggaatttcaacaagaagcctccctaatggcagaactgcaccaccccaatattgtctgccttctaggtgccgtcactcaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccag

SEQ ID NO: 1113 - DNA, 3089 bp, Homo sapiens
aaagattccgaggtgcagaagttgtctgagtgggttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttcccaggtgaagtgcttatggcttaaggaactcttggccattcaaaggacttttcattttgattaacaggactagcttatcatgagagcctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagtacagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataat

SEQ ID NO: 1114 - DNA, 6034 bp, Homo sapiens
ccacgcgtccggagctggaggaggcggcgggcgcgagacccggaatgcgcagggcccccgcctcgccccccccagcccgggccgcggcccccgccttccccgcagtcgtcccgcactcggtgcccgccccccgaggccggcggctgctcccactcggggccgttgctgcttgtgccgtgagcgccgcccagccattgtccccgtcgctccgtcagccgcgccggaccgcgcaccaggaggcgagagcgcgcatggggagcctctgttgatgccgccgccgcgccgccctccgaggctgcgtcccgggaagcccggctccccgagcgctccggcctggcccggtgccccggacctgagtgcgtccccatggaggcgcccgggctggcccaggcggccgcggcggagagcgactcccgcaaggtggcggaggagacccccgacggggcgcccgcgctctgccccagccctgaggcgctgtcgccggagccgcctgtgtacagcctgcaggactttgacacgctggccaccgtgggcactgggacgttcgggcgggtgcacctggtgaaggagaagacagccaagcatttcttcgccctcaaggtgatgagcattcctgacgtcatccgcctaaagcaggagcaacacgtacacaatgagaagtctgtcctgaaggaagtcagccacccgttcctcatcaggctgttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccgttttttgatgacaacccgtttggcatttatcagaaaattcttgcaggcaaaatagatttccccagacatttggatttccatgtaaaagacctcattaagaaactgctcgtggttgacagaacaaggcgattaggaaacatgaagaacggggcgaatgatgtgaagcatcatcggtggttccgctccgtggactgggaagctgttccgcagagaaaactgaagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaagaaacaggaagattggaatctgcctggaacaaagaactgcacctaagcagaccagaagcaaaatgtcttcttcacggcataaggacatctccacttttctctgtacctgtgtgtatagaaatagattagagcacagttgaaattcatggaactggcattatttaagcaactggaattccacactgtaggaaggttttgaaaattgtttggttgtagattttatcttatcctttagtgttgtgttcctactgtgatgtcttggtttttgtcatagacttaagtttataagtttgaactggacttgttcgattataaccacaaattgtgtgtgtgtgtgtgtgtgtgtgtgtgtgtgtgtgtatgcctgtgtgtatatatagaagtcattatggcagatgcacagaaattgtgcagtgatgtaaatgttcatactttacagagcctataatttttatttttcaatttgttttttcaaaaatctcttctcggggacaacatctgaagggtatgttgcatgcattaaaaaaaatcatctcacatgcattttatagttttggggaagaaaatatcatggggaggtctaccttcagtatctttagttcttcttaccgggtaacttgagactttaaaagaagaaacaaagaggggaagatatgggagcgaatttattccaagaatctacaatgacattgaagttgttggaggaatgtactgtatttaaaaaaaccttctgtgacacattcaaaaatttcatctgagctggatgcagtggcttgttcctatagtcccagcactttgggaggctgaggtgggtggattgcttgagcccaggagttggagaccagtctgggaaacgtggtgagacctcatctctacaaaatacaaaaaaattagccgggcatggtggcacgtgagttaggtctcagctactcaggaggctgagatgagaggatcacttgagcctggggaggtccaggccgcagtgatccgagatcacaccactgcattccagcctgggtgacagagtgagaccctgtccaaaaaaaaaaaaaaaaaaaagaaggcaatggctttgtgcttttgaagatggattgaagagaacgtccaccttaaggctttaaaagacagtgaagctgggtgcggtggtgcactcctgtaaccctgggactttgggaagctgaggcaggaagattgagcctaggagttcgagactgacctgggcagcatagcgagaccccatctctatataaaaaaaaagatgttaaaacagtgaaattacagaaacagaacatagccaccctttttcatcagtgaccttttcttcacgtggaggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttaccgtgaatgtgaaaaggtgaaactggtgctgacttcggcagcaggtatactaaaattggaatgacacagaggagattagcatggccccctgcgcgaggaagatctgcagattcatgcagcattccatatttttttaagaaaaggttacactgtgcaccgacatgtggagctagaaggaaaagcttttaagtctcatgtttgctgactataaaaataaatcatagtaataatattgaacattctactttaaaaattattaataaaaccataaatgaaacacttgagcacactttaaaaagtacataaatccatgagtccatatgcctatttttaggttgtctgttttattatccaggatttcatactcagatgagaattagcatcaggaaagcctgaaatgccttaattgtgaactgatatgcaggaaaatgaaatatgcaagcacattggtgaccttgttctttacagacgtcgtgatcagcctccagccatacagaacaaatgagaaattagaagcgattccaagaacgtgtgatggtgtgaacccactttggaccatcacacacatttcagcatttgaagtgacacaagctacctggtaactgcccatggcggggtcatagtttaaatggcccaatgtcatgtagaggttaatttaatcaaaatgagctataaacatggagcaatcactgtataattttaaaatagtttacctggccaggcatggtcgtcacgcctgtaatcccagcactttgggaggccgaggcaggtggatcacctgaggtcaggagttcgagaccagcctggccaacatggcaaaacccccgtctctactaaaatacaaaaattaggtgtggtggcgggcacctgtaatcctggctactcgggaggctgaggcaggagaatcgcttgaacccgggaggcagaggctgcagtgagccgagatcgtgccactgcactccagcctgggccacagagcaagactccgtctcaaaacataaaaataaaaaaaatacaaatagctgacccgggtgggcattccaaaatgtccgcatggacgatcacgaaacaatcacggtgcgaaatgtccgcatggatgatcacgaaacaatcacggtgcggaatgtccgtatggatgatcatgacaaacaatcactgcgcaaaatgtggaggaaaattcattaccataatcacaacatttgtatcagaaaaacattacaaatttactttgcttcatgtaattttacgagttggcaatattttcttaaattggaatactctaagagaataggacatggatatgttacaagaagaagtgtattggggcaagtcttgtttttctgaagggaaatgccaccggcctgctttcataggcattgataaagccaggaaggaaataaagtcacaaccaaatagtatacactgtctctactgaattcttctaattccttcgcaacagaagtctaaatcctgcttagcctaaacatatctatagccagcgatgggcaaattatatttgctgtcagcatgatagaataagaagcagaaaccccccagcagtggggtaagattgcgcgcttcatcccctcaaaatgcagctcagccccactccctctccatgcccatcaaacaactgcacaatcacttgttactgaatttcccattcagcgttttgtttctttctgtccatacttaaagaccaaatcatttgtttgctttgaagaaaaagcaaaaacaagaacaaaaacaccaaatcatttgaaatcactgtccattaaaaaaaatcaccagtggaactaaacagttgagtggtttgggatgtgttcgccatttctgtgtttgacctacatggcctgtaattctttggaccattgtaactgtgaactatggcttaatactgttaaagaccccaaggctccactctgtagccaggtgcacctcaggctgcacaaataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttgctctcgtttttccttcaagctacctagcatgcattttacacacattggaggagtcgtatgcactgtttttctgttgctgatggaggcaagcaggccttctaattagtctaagttaaacggatgggattcacttaagaaaagcaagaagaaaagcacacgaacaggtgtcttaatgcatttggatagtttctttgcggggtgtgtgtgtgtgtgtgtgtgtgtgtgtgtgtgtgtgtgtcttggtgaaggtgaggggctgtattttcaccaagccttttcataatcaagtttgctttgcaaaccttatggccttgcaccccgcagaacagtcccttcctaatagcagggatgctctgtcatggtttttctgtaaattatcgtgtgttgggaagttctgttgaggcttagtttgatcttccatggtggacacgtctgttctgtatgtaaaaggcattacaattgtgttttagcagatgagacttgaagcctttccacagtccttgtgctctgagatggctgttgagctctgctcaactgtcgtagctgaattctttctttgcgctgaacactgggcagcctcaccatgttgccaacgtgcttctggggcccctgtcactgccgctggatgccgcgcacacaggcagagtgccttggcaggtttgtgcaccccttggcgagccagaactgggaaccccgcggggtgaccccttctcatggggggtcggggaggggagtgcctatttttaatcctgtctgtttgttgcacaatggaaatcactgtgatttgtacatatgccctaggaaaattttactgctgtctaatttatgtaataatactgttgattccaggtttatttaataaaactttgtatcttttcagaaaaaaaaaaaaa

SEQ ID NO: 1115 - DNA, 969 bp, Homo sapiens
ggatttccgggctccatggcaagatcccttctcctgcccctgcagatcctactgctatccttagccttggaaactgcaggagaagaagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaatgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaacctcatgccctgttgataaaccaatcaaattggtaaagacctaaaaccaaaacaaataaagaaacacaaaaccctcaa

SEQ ID NO: 1116 - DNA, 3201 bp, Homo sapiens
ggatccgcgcggcacacgtgcgacggccgtgatgaagttcgcttaccggttttcaaatttgctgggtacggtgtaccggcgtgggaacctaaattttacctgcaatggaaattcagttatcagtcccgtgggcaatagagtcactgtatttgaccttaaaaacaacaaatctgacacgctgcccctggccactcggtacaacgtcaagtgcgtggggctgtccccggatggccgcctcgctatcatcgtcgatgaagggggcgatgcgctgctggtcagcctggtctgcaggtctgtgctgcaccacttccacttcaagggctctgtgcacagtgtgtccttctcccctgatggcaggaagtttgttgtcacaaagggtaacattgcccagatgtatcatgcccctgggaagaagcgggagttcaacgccttcgttctggacaagacctattttgggccctacgatgagaccacctgcatcgactggacggatgactccaggtgctttgtggttgggagcaaagacatgtccacctgggtgttcggagccgagcgctgggacaacctcatctactatgcactggggggacataaggatgccatcgtggcctgcttctttgaatccaacagcctggacctgtactcactcagccaggacggagtgctgtgcatgtggcagtgtgacacgccccccgagggcttgcggctgaagccccctgcgggctggaaagcagacctgttgcagcgggaggaggaagaggaggaggaggaggaccaggagggcgacagagagaccaccatccggggaaaagccactccggccgaggaggagaagacaggaaaagtgaagtactcacggctggccaagtacttcttcaataaagaaggggattttaacaacctgacagctgcagcatttcataagaagtctcacctcttggtcactggctttgcttctggaatcttccatcttcatgagctgccagagtttaacctcatccactccctgagcatctcagatcagagcatcgcctcagtggccatcaatagctcgggggactggattgcttttggctgttcaggcctgggccagctgctggtgtgggagtggcagagtgagtcctacgtgctcaagcagcagggccacttcaacagcatggtggccctggcctactcgcccgacggacagtacatcgtgactggcggggacgacggcaaggtcaaggtgtggaataccctcagcggcttctgcttcgtcacttttacggagcactccagcggggtgaccggtgtgacctttactgccaccggctacgttgtggtgacctcatccatggacgggaccgtgcgagcctttgaccttcacaggtaccgaaacttccgcaccttcacctctccacgccccacccagttctcctgtgtggcggtggatgcgagcggtgagatcgtctctgcaggggcgcaggactcctttgagattttcgtgtggtccatgcagacaggcaggctccttgatgttttgtctggacacgaagggcccatcagtggtctgtgttttaacccaatgaagtccgtcctggccagtgcctcctgggacaagacggtgcgcctatgggacatgtttgacagctggaggaccaaggagacgctggccctgacctctgatgctctggctgtgacttttcgccctgatggtgcggagctggctgtggccacactgaactcacagatcaccttctgggaccctgagaacgcggtgcagacgggctccattgagggcaggcatgacctcaagactggcaggaaggagctggacaagattacagccaagcacgcggccaaggggaaggccttcaccgccctgtgctactctgcagacggccacagcatcctggcgggaggcatgtccaagttcgtgtgcatctaccacgtccgtgagcagattctcatgaagaggttcgagatctcttgcaacctgtctctggacgccatggaggaatttttgaaccgaagaaaaatgacagagtttggcaacctggcactaattgatcaggatgctgggcaggaggatggagtcgcgataccactgccaggcgtcaggaaaggtgacatgagttctcggcacttcaaacctgagatcagggtgacctcactccgcttctctcccactgggcgctgctgggcgggcaccaccacggagggactcctcatctactccctggacacccgcgtgctctttgacccgtttgagctggacaccagcgtcacccccgggagggtgcgcgaggcactgcgccagcaggacttcaccagggccatcctcatggccctccggctcaacgagagcaaactggtgcaggaggccctggaggcggtgcccaggggcgagattgaagtggtcacctcctcccttcctgaactgtatgtggagaaagtgctggagtttttagcttcctcctttgaagtgtctcgccacctggaattctacctcctctggactcacaaactgctcatgttgcacggacagaagctgaagtccagagccgggacgctgctgcctgtcattcagttcctccagaagagcatccagcggcacctggacgacctgtcgaaactctgtagctggaaccactataacatgcagtacgcactagcagtttccaagcagcggggcacaaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccagggagatgggacccttgtgccacctgggccagcaaagaggaggggtccagagaacagctgaaatactgtcactagtggtagtgacttgcttttcctgtgcacacatgtagcccatcaggacagcgagccgacgggtcacgccaggggccggcacgcactggcacctggccccaggagcgggcccgtgtgaacggtgatgaatgttgaaaatgcgtctcagagaggtattcacatgaactttgtatgagacttatttatatttttaacataaaggtttgataaagaacttagggattaaaaaaaagatggagttttctaacgtgaggatgaagtctacacttcagattaaaaagggttatgttgta

SEQ ID NO: 1117 - DNA, 975 bp, Homo sapiens
atgagccgcccgtcctccaccggccccagcgctaataaaccctgcagcaagcagccgccgccgcagccccagcacactccgtccccggctgcgcccccggccgccgccaccatctcggctgcgggccccggctcgtccgcggtgcccgccgcggcggcggtgatctcgggccccggcggcggcggcggggccggcccggtgtccccgcagcaccacgagctgacctcgctcttcgagtgtccggtctgctttgactatgtcctgcctcctattctgcagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgccttgttttcgacacagccatagcacatctttttgcagataatgggaaccttggaatcaatgttactatttctacatgttgtccatga

SEQ ID NO: 1118 - DNA, 2352 bp, Homo sapiens
acagagccccgccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagagttgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgcccgcggccgccgtggtcggtacgggcgctcccccatggtggggtttgatcctccccctcacatgagagtacctaccattcctccaaacctggcaggaatccctggggggaaacctgcatactccttccacgttactgcagacggtcagatgcagcctgtcccttttcccccgacgcccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggt

SEQ ID NO: 1119 - DNA, 1836 bp, Homo sapiens
ggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgcaaaaaaaaaaaaaaaaa

SEQ ID NO: 1120 - DNA, 1505 bp, Homo sapiens
gctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagagactaagctgaaactgctgctcagctcccaagatggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgtagctattgatcttagcaacaaagcttcattagcattcttacaaaagcatttaggacttcataaagattttgatcagtgggactgcttgattgaaggagatgatgagaatcttattccagggaccaacattaacacaaccaatcaacacatcatgttacagaactcttcaggaatagagaaatacaattaggattaaaataggtttttt

SEQ ID NO: 1121 - DNA, 7288 bp, Homo sapiens
ttcttgtcccacagtgcctggcccagaagccttgctaaatatttgaacaggattgcccaatacttttctgctgtgagaatgtaagatggatccagaagagcaggagctcttaaatgattacagatacagaagctactcttcagtgattgaaaaggctttgagaaattttgagtcctcgagtgaatgggcggatctcatatcttcacttggcaaactcaacaaggctcttcagagtaacctgaggtactccttgttgccaagacggctcctcatcagcaaaagattagctcagtgtttgcaccctgccctgcccagtggtgtccacttaaaagctctggaaacctacgagattatctttaaaatcgtggggaccaaatggctggccaaggacttgtttctgtacagctgcgggttatttcctctcctggcacacgcggcggtgtcggtgaggccggtgctgctcaccctgtacgagaagtacttcctcccactgcagaagctgctcctgcccagtctgcaggccttcatcgtgggcctgctgcccggccttgaagagggctccgagatctccgacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgaagtctttgcgtgcctccctgttggactcaaatgttcttgtgcaaagaaataatctggaaatcgttctgtttttcttcccattttatacctgtctggattccaatgagagagccatccccctcctcagatctgacatcgtgcgcattctctcagccgccacccagaccctactgagaagggacatgtccctgaacagaagactgtatgcatggttactaggctcagacataaaaggaaataccgttgtgccagaatctgaaatctcaaattcttatgaagaccagtcgtcttatttttttgaaaaatactccaaggatcttttagttgagggtttggctgagatattgcatcagaagttcatagatgctgacgtggaggaacgccatcatgcatacctgaagccttttcgcgtcctcatcagtctgcttgacaagccagaaatagggcctcaagtggttgggaatttgtttctcgaagtcatcagggccttttattcttactgcagagatgcccttggctctgatcttaaacttagctacacccagagtggaaattcgctgataagtgcaatcaaggaaaacagaaatgcctctgagattgtcaaaacggtaaatttgctgataacttctctaagcacagactttctctgggattatatgacaaggtgttttgaggaatgctttagaccagtgaagcagcgttacagcgtgaggaacagcgtcagccctccccccacggtctcggagctctgcgccctcctggtcttcctgctggatgtcattcctttggaactttactctgaggtgcatacccagtatctccctcaggtgctcggctgcctggtgcagcctcttgctgaggacatggaggccttaagtttacctgaactcacgcatgccttgaagacgtgtttcaaggtgctcagcaaagtccagatgcctccttcctacctcgacacggagtccaccagcggaacctcgagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggagccggtgattccagttttccatcttggctgaagtccctcatgactatttgctgctgtgtgactgactgctacctccagaacgtggccatttccactctgctggaagtgataaaccattcccagtccctggcgcttgtcattgaagacaagatgaaacgctataagagctctggacacaaccctttttttggcaagctgcagatggtgacggttcctcccattgctccagggatattgaaagtcattgcagagaaaacagatttctatcagagggtggctcgcgtgctttggaatcagctgaacaaagagacccgggagcatcacgtcacctgcgtagaattgttctaccggctgcactgcctggcccctacggccaacatctgcgaggacatcatctgccatgccctcctggaccctgacaagggaacaaggctggaagctctgtttagattttccgtgatctggcatctgacaagagagatccaaggcagtcgagtaacatctcacaatcgctcctttgataggtccttgtttgtcgtgctggacagcctggcctgcacggatggtgccatcggtgcggcagcccagggctggctggtgcgtgcgctctccctcggggacgtggctcgcatcctcgaacccgtgctcctgctgctgctgcagccaaaaacccagagaacctccatccactgcctcaagcaggagaactcggccgatgacttgcaccgttggtttaacaggaagaaaacctctttcagagaggcatgcgcagtgcccgagcctcaggagagcggctctgaagagcacctgcctctgagccagttcaccacagtggaccgtgaagccatttgggccgaagtggagaaggagcccgagaagtacccgctgcgaggcgagctgagcgaggaagagctgccctactacgtggagcttccagacaggacggcccacggcgccccggacagcagcgagcacaccgagtctgcagatacaagctccggccacacggacagcgagaacacgtcctccttctcctccccttcccacgacctgcaggagctgagcaacgaagagaactgctgtgcacccatccacatggggggcagggcgtaccccaagcgctcggccctgctggcggccttccagtcagaaagcttcaaggctggggccaagttaagcctggtgcgggtggactcggacaagacgcaggcttctgagtcgttctccagcgacgaggaggcggacttggagctccaggccctcaccacatccaggctgctaaagcagcagcgggaaaggcaggaggccgtcgaggccttgttcaagcacatcctgctctacctgcagccctacgactctcggcgggtcctctatgccttctcggtgctggaggctgtgctcaaaaccaaccctaaggaattcatcgaggctgtgtccaggactagcatggataccagctccaccgcgcacctcaacctcatctccaacctcctcgctcgccaccaggaggccctcattggccagagtttctacggaaagctccagacccaggtccccaacgtgtgcccccactctctgctcctggagctgctcacctacccctgcctgagcttcctgcgctcctactacccttgctatttgaaggtctcgcaccgagacattctcggcaaccgggacgtgcaggtcaaaagtgtcgaggttttgatcaggataatgatgcagctggtctcagtggccaagtcttcggaagggaagaacgtggagttcatccacagcttgctgcagaggtgcaaagttcaggagtttgtcctgctctccctgtcggcgtccatgtacacgagccagaagcgctacgggctggccaccgcccaccacggcagggccctgccagaggacagcctctttgaggagagtctcattaacttgggtcaggaccagatctggagtgagcacccgctgcagattgagctgctgaagctgctgcaggtgctgattgtcttggaacaccacctgggtcgggcccatgaggaggcggaaaaccagcccgacctgtcccgggagtggcagagagccctgaacttccagcaggccatcagcgccctgcagtacgtgcagccccaccccctcacctcccagggtcttctggtctctgcggtggtgaggggtctgcagcccgcctacggttacggcatgcatccggcctgggtgagcttggtcacgcattccttgccctacttcggaaagtccctgggctggacggtgacaccctttgttgtccagatttgcaaaaacttggatgacttggtcaagcagtatgaaagcgaatctgtgaagctctctgtcagcacaacctccaagagggaaaacatttctccagattatccactcacccttctagaaggtctaacgaccattagtcatttttgtcttttggaacaagccaaccaaaacaaaaagaccatggctgcaggtgatcctgccaacttgaggaatgccagaaatgccattttggaagagctgcctcgaactgttaacaccatggcccttctctggaatgttctcagaaaggaggagactcaaaagagacctgtcgatctcctaggggccacgaagggatcctcttccgtttactttaaaaccaccaaaaccataagacaaaaaattttagacttcttaaaccccttgacggcccatcttggggttcagttgacagcggctgttgcggcagtgtggagcagaaagaaagcccagcgtcacagtaagatgaagattatcccaacggcaagtgcatcccagctaacccttgtcgacttggtgtgtgcactcagcaccctgcagactgacacgctgctgcacctggtgaaggaggtggtgaagaggccaccccaagtcaaagggggtgatgagaaatcgcccctagtggacattcctgtgttgcagttttgctatgcttttctccaaaggctcccagtaccagccttgcaagagaacttttcttcactgttgggagtattgaaagagtctgtacagttgaatctagccccacctgggtattttctgcttctcagcatgctgaatgactttgtaacaagaactcccaacctggaaaacaagaaggaccaaaaagacctgcaggaaatcactcagaaaatcctagaagctgtggggaacattgccggctcttccttggagcaaaccagctggctaagcagaaacctggaagtgaaggcccaacctcaggcctctctagaagaatctgatgctgaggaggacctgtatgatgctgctgcagcttcagcaatggcgtcttcatccgccccgtcggtgtacagcgtgcaagccctctctctcctggcagaggtactggcttccctcctggacatggtttatcgaagtgatgagaaggagaaagctgtgccgttaatctcccgtctgctttactatgtttttccatacttacgcaaccacagtgcctacaatgctcccagcttccgggctggcgctcagctgctgagctccctgagtggctatgcctacacaaagcgagcctggaggaaggaggtcctggggctgtttctcgaccccgctttctttcagatggatacttcctgtgttcattggaagtccattattgaccatcttttgactcatgagaaaacaatgtttaaggatttaatgaacatgcagagcagttctttgaaactattctcaagttttgaacagaaagccatgctgttaaagcgccaggcttttgctgtcttcagtggagaacttgatcaataccacctttaccttccactgatacaagaacgcctgacagacaatctcagagttggacagacatccatagttgctgctcagatgtttctttttttcagagttttgctgctaagaatatctcctcaacatttgacttcattgtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcagattcttggacacagcgctttcttttccacctgacaagatgccattatttcaaatttataggtgggcatttattccagaagtggacacagagggccctgccttcctgtcggatgtagaggagaatcaccaagaatgcaaaccccacactgtcaggattctagaacttctaaaattaaagtttggggaaatcagtagctctgatgagatcaccatgaagagtgaattcccgcttctgcgccaacattctgtttccagcatcaggcagttgatgccattcttcatgactctaaatggtgcatttaagacccagagacagctgcctgctgatagcccaggaactccattcttggactttcctgtcacagatagcccaaggatcttaaaacaactggaagaatgcatcgaatatgattttctggaacatccagaatgttaaccatgtgagagagaatatgtttaatccatgtattggtactttactgaaaaccaggttatattctaaagaagaaagaaggcaggatagtgcttttgaacaagcctatttccattttgaaagtagatttcaggctaggtgcggtggctcacacctgtaatctcagcactttgggaggccaaggcaggcagatcacttgaggtcaggagttcgagaccagcctgaccaacatggtgagaccctgtctctactaaaaatacaaaaattagctgggtgtggtggcggcgcctgtaatcccagctacttggg

SEQ ID NO: 1122 - DNA, 1163 bp, Homo sapiens
ctctacctgacacagctgcagcctgcaattcactcccactgcctgggattgcactggatccgtgtgctcagaacaaggtgaacgcccagctgcagccatgaagatctgtagcctcaccctgctctccttcctcctactggctgctcaggtgctcctggtggaggggaaaaaaaaagtgaagaatggacttcacagcaaagtggtctcagaacaaaaggacactctgggcaacacccagattaagcagaaaagcaggcccgggaacaaaggcaagtttgtcaccaaagaccaagccaactgcagatgggctgctactgagcaggaggagggcatctctctcaaggttgagtgcactcaattggaccatgaattttcctgtgtctttgctggcaatccaacctcatgcctaaagctcaaggatgagagagtctattggaaacaagttgcccggaatctgcgctcacagaaagacatctgtagatattccaagacagctgtgaaaaccagagtgtgcagaaaggattttccagaatccagtcttaagctagtcagctccactctatttgggaacacaaagcccaggaaggagaaaacagagatgtcccccagggagcacatcaagggcaaagagaccaccccctctagcctagcagtgacccagaccatggccaccaaagctcccgagtgtgtggaggacccagatatggcaaaccagaggaagactgccctggagttctgtggagagacttggagctctctctgcacattcttcctcagcatagtgcaggacacgtcatgctaatgaggtcaaaagagaacgggttcctttaagagatgtcatgtcgtaagtccctctgtatactttaaagctctctacagtccccccaaaatatgaacttttgtgcttagtgagtgcaacgaaatatttaaacaagttttgtattttttgcttttgtgttttggaatttgccttatttttcttggatgcgatgttcagaggctgtttcctgcagcatgtatttccatggcccacacagctatgtgtttgagcagcgaagagtctttgagctgaatgagccagagtgataatttcagtgcaacgaactttctgctgaattaatggtaataaaactctgggtgtttttcaaaaaaaaaaaaaaaaa

SEQ ID NO: 1123 - DNA, 1339 bp, Homo sapiens
gaattccgattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctactccattaaatataaagcaagataataaaacggaattc

SEQ ID NO: 1124 - DNA, 1381 bp, Homo sapiens
cagccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatccgaatctgggtccgagtcggagccggacgcaggcccagggcccaggccggggccgctgcagaggaagcagccgatcgggccggaggacgtgctggggctgcagcggatcaccggtgactacctctgctcccctgaggagaatatctacaagatcgactttgtcaggtttaagattcgggacatggactcaggcactgtcctctttgaaatcaagaagcccccagtctcagaacggttgcccatcaaccggcgggacctggaccccaatgctgggcgctttgtccgctaccagttcacgcctgccttcctccgcctgaggcaggtgggagccacggtggagttcacagtgggagacaagcctgtcaacaacttccgcatgatcgagaggcactacttccgcaaccagctactcaaaagcttcgacttccactttggcttctgcatccccagcagcaagaacacctgcgagcacatttacgacttcccccctctctccgaggagctgatcagcgagatgatccgccacccgtatgagacccagtctgacagcttctacttcgtggatgaccggctggtgatgcacaataaagcagactattcctacagcgggacaccctgatcccacggctgccctgaccccaggaggctccagttctgggctgggagctgtgacctccccaacgctcacccctcaaccccaagtcctctgcttggggagttctccaggagctccggaccctgagtcaatgttgggaggaagggtacctggtgtccccagtcaagcccatgaagcccatgcggcctgctacatggggtggggtcgtagggaggctgtttgcctccacgtctaggaaggcctgtgagaggagcagtcaggacttccggacaacttagctgggccctacttgggcccaagtttcagaatagtgttcccctatcaaggctgtgactagatcaggcagggatccattccctgtcccctgcccactaccttcaggccatttagagttgtaaatttacaaagatccacggtgggctccagctgccaagccacccaagggagtctgggccctaggcctagccccatccctccccatgaggggccaagacactgcctaaggtgtgggagggactggctgagattgcagcccatggtaggagctggaccaactgtatatagttttcaataaactttttccttttctgttcaaaaaaaaaaaaaa

SEQ ID NO: 1125 - DNA, 735 bp, Homo sapiens
atgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgagaattacgttcctacagtgtttgagaattacacggccagttttgaaatcgacacacaaagaatagagttgagcctgtgggacacttcgggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtga

SEQ ID NO: 1126 - DNA, 1508 bp, Homo sapiens
gagcgcggttaccggacgggctgggtctatggtcgctccgcggccgctccgccgcgtggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaatagtttttctttaatatgattctagtacataattgattgattaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtaccgtatattgatttaaaagtgtattttattcagtagtttgagg

SEQ ID NO: 1127 - DNA, 10096 bp, Homo sapiens
ggagaagcgggcgaattgggcaccggtggcggctgcgggcagtttgaattagactctgggctccagcccgccgaagccgcgccagaactgtactctccgagaggtcgttttcccgtccccgagagcaagtttatttacaaatgttggagtaataaagaaggcagaacaaaatgagctgggctttggaagaatggaaagaagggctgcctacaagaactcttcagaaaattcaagagcttgaaggacagcttgacaaactgaagaaggaaaagcagcaaaggcagtttcagcttgacagtctcgaggctgcgccgcagaagcaaacacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaactagaggtgactccaagtcgatcaactttgcaaatagggaaaagagatgctaatagcagtttctttggcaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctttaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggttgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaagatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtggaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaagggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatat

SEQ ID NO: 1128 - DNA, 439 bp, Homo sapiens
actttggttccagcatcctgtccagcaaagaagcaatcagccaaaatgatacctggaggcttatctgaggccaaacccgccactccagaaatccaggagattgttgataaggttaaaccacagcttgaagaaaaaacaaatgagacttatggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttcca

SEQ ID NO: 1129 - DNA, 366 bp, Homo sapiens
gtcagctcagcctccaaaggagccagcctctccccagttcctgaaatcctgagtgttgcctgccagtcgccatgagaacttcctaccttctgctgtttactctctgcttacttttgtctgagatggcctcaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaactttttataagcattcttttaataaaggaaaattgcttttgaagtat

SEQ ID NO: 1130 - DNA, 5484 bp, Homo sapiens
aattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggagtgaaattggacacagccctcctcctgcctacacccccatgtcaggaaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaacttgaacattagagggaaagactgaaagagaaagataggaggaaccacaatgtttcttcatttctctgcatgggttggtcaggagaatgaaacagctagagaaggaccagaaaatgtaaggcaatgctgcctactatcaaactagctgtcactttttttctttttctttttctttctttgtttctttcttcctcttctttttttttttttttttaaagcagatggttgaaacacccatgctatctgttcctatctgcaggaactgatgtgtgcatatttagcatccctggaaatcataataaagtttccattagaacaaaagaataacattttctataacatatgatagtgtctgaaattgagaatccagtttctttccccagcagtttctgtcctagcaagtaagaatggccaactcaactttcataatttaaaaatctccattaaagttataactagtaattatgttttcaacactttttggtttttttcattttgttttgctctgaccgattcctttatatttgctcccctatttttggctttaatttctaattgcaaagatgtttacatcaaagcttcttcacagaatttaagcaagaaatattttaatatagtgaaatggccactactttaagtatacaatctttaaaataagaaagggaggctaatatttttcatgctatcaaattatcttcaccctcatcctttacatttttcaacatttttttttctccataaatgacactacttgataggccgttggttgtctgaagagtagaagggaaactaagagacagttctctgtggttcaggaaaactactgatactttcaggggtggcccaatgagggaatccattgaactggaagaaacacactggattgggtatgtctacctggcagatactcagaaatgtagtttgcacttaagctgtaattttatttgttctttttctgaactccattttggattttgaatcaagcaatatggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatatgaagtagaaggtaactctttgcacataaattggtataataaaaagaaaaacacaaacattcaaagcttagggataggtccttgggtcaaaagttgtaaataaatgtgaaacatcttctc

SEQ ID NO: 1131 - DNA, 14756 bp, Homo sapiens
ctgggcggccgggcgcggggagagggcgcgggagcggctcgtgcggcaggtaccatgcggacgcgcgagcccggcgaggccccggcaggcccgtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtgacattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaaggacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactatcatgagcctgagtgccgtagaccctgatgagggtgagaatgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttgtttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattcttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccggaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcgcgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaacagtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgtttcaccagcacacctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggagtccaatcaatgagcctttgttttatcacatcctcaacccagatcgcagatttaaaataagccgcacttcaggggttctgtcaaccactggcacgcccttcgatcgtgagcagcaggaggcgtttgatgtggttgtagaagtgatagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatggtaatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgtaaagtctgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctgttggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtcgtcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaacccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtccctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaat

SEQ ID NO: 1132 - DNA, 2559 bp, Homo sapiens
tttttttttaattcctgaggggtggttgctgcttttgctacatgacttgccagcgcccgagcctgcgtccaactgcgctgctgccggagcgctcagtgccgccgctgccgcccgccgcccccccgcgccccgttcggcacccaccggtcgccgcgccgcccgcgcgccgctgtcccgctcccgcgccgccgccgccgtttccccccgacgactgggtgatgctggacatgggagataggaaagaggtgaaaatgatccccaagtcctcgttcagcatcaacagcctggtgcccgagggcctccagaacgacaaccaccacgcgagccacggccaccacaacagccaccacccccagcaccaccaccaccaccaccaccatcaccaccacccgccgccgcccgccccgcaaccgccgccgccccgagccgcgcagcagcagcagccgccgccgccgccgctcgccccgcaggccggcggcgccgcgcaatcgaacgacgaaaagggcccccagctgcttctgctcccgccgaccgaccaccaccggccgccgtccggagctaaagccggaggctgctgccggcctggggagctggggcccgtcgggccggacgagaaggagaagggcgccggcgctgggggggaggagaagaagggcgcgggcgagggcggcaaggacggggaggggggcaaggagggcgagaagaagaacggcaagtacgagaagccgccgttcagctacaacgcgctcatcatgatggccatccggcagagccccgagaagcgcctcacgctcaacggcatctacgagttcatcatgaagaacttcccttactaccgcgagaacaagcagggctggcagaactccatccgccacaatctgtccctcaacaagtgcttcgtgaaggtgccgcgccactacgacgacccgggcaagggcaactactggatgctggacccgtcgagcgacgacgtgttcatcggcggcaccacgggcaagctgcggcgccgctccaccacctcgccggccaagctggccttcaagcgcggtgccgcgctcacctccaccggcctcaccttcatggaccgcgccggctccctctactggcccatgtcgcccttcctgtccctgcaccaccctcgcgccagcagcactttgagttacaacgggaccacgtcggcctaccccagccaccccatgccctacagctccgtgttgactcaaaactcgctgggcaacaaccactccttctccaccgccaacgggctgagcgtggaccggctggtcaacggggagatcccgtacgccacgcaccacctcacggccgctgcgctcgccgcctccgtgccctgcggcctgtcggtgccctgctccgggacctactccctcaacccctgctccgtcaacctgctcgcgggccagaccagttactttttcccccacgtcccccacccgtcaatgacttcgcagagcagcacgtccatgagcgccagggccgcgtcctcctccacgtcgccgccagcccctcgccccctgccctgtgagtctttaagaccctctttgccaagttttacgacgggactgtctgggggactgtctgattatttcacacatcaaaatcaggggtcttcttccaaccctttaatacattaacatccctgggaccagactgtaagtgaacgttttacacacatttgcattgtaaatgataattaaaaaaataagtccaggtattttttattaagcccccccctcccatttctgtacgtttgttcagtctctagggttgtttattattctaacaaggtgtggagtgtcagcgaggtgcaatgtggggagaatacattgtagaatataaggtttggaagtcaaattatagtagaatgtgtatctaaatagtgactgctttgccatttcattcaaacctgacaagtctatctctaagagccgccagatttccatgtgtgcagtattataagttatcatggaactatatggtggacgcagaccttgagaacaacctaaattatggggagaattttaaaatgttaaactgtaatttgtatttaaaaagcattcgtagtaaaggtgcccaagaaattattttggccatttattgttttctccttttctttaaagaactgtttttttttcttttgtttacttttagaccaaagattgggttctagaaaatgcgccttggtatactaagtattaaaacaaacaaaaaggaaagttgtttcagttggcaacgctgcccattcaattgaatcagaaggggacaaaattaacgattgccttcagtttgtgttgtgtatattttgatgtatgtggtcactaacaggtcacttttattttttctaaatgtagtgaaatgttaatacctattgtacttataggtaaaccttgcaaatatgtaacctgtgttgcgcaaatgccgcataaatttgagtgattgttaatgttgtcttaaaatttcttgattgtgatactgtggtcatatgcccgtgtttgtcacttacaaaaatgtttactatgaacacacataaataaaaaatag

SEQ ID NO: 1133 - DNA, 2897 bp, Homo sapiens
ggaattccgcgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggtggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtgccttcatcacggcggcttggattgtcctgtgccaactgtcacaccacaactaccaccttatggcgcagaaacgccgagggtgaacccgtgtgcaatgcttgtggactctacatgaaactccatggggtgcccagaccacttgctatgaaaaaagagggaattcaaaccaggaaacgaaaacctaagaacataaataaatcaaagacttgctctggtaatagcaataattccattcccatgactccaacttccacctcttctaactcagatgattgcagcaaaaatacttcccccacaacacaacctacagcctcaggggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcggtccagacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccaaaatcatgtgcttcttctgatcaattttggttgttccagaatttcttcataccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaattttttttttgaatgggatgtcctatggaaacctatttcaccagagttttaaaaataaaaagggtattgttttgtcttctgtaaaaaaaaaaaaaaaaaaaaaaaaaaaaaaaaaaaaaaaaaaa

SEQ ID NO: 1134 - DNA, 2560 bp, Homo sapiens
gaattccggccagaagaaatctggcctcggaacacgccattctccgcgccgcttccaataaccactaacatccctaacgagcatccgagccgagggctctgctcggaaatcgtcctggcccaactcggcccttcgagctctcgaagattaccgcatctattttttttttcttttttttcttttcctagcgcagataaagtgagcccggaaagggaaggagggggcggggacaccattgccctgaaagaataaataagtaaataaacaaactggctcctcgccgcagctggacgcggtcggttgagtccaggttgggtcggacctgaacccctaaaagcggaaccgcctcccgccctcgccatcccggagctgagtcgccggcggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcaccatgttcctggcgaccctgtacttcgcgctgccgctcttggacttgctcctgtcggccgaagtgagcggcggagaccgcctggattgcgtgaaagccagtgatcagtgcctgaaggagcagagctgcagcaccaagtaccgcacgctaaggcagtgcgtggcgggcaaggagaccaacttcagcctggcatccggcctggaggccaaggatgagtgccgcagcgccatggaggccctgaagcagaagtcgctctacaactgccgctgcaagcggggtatgaagaaggagaagaactgcctgcgcatttactggagcatgtaccagagcctgcagggaaatgatctgctggaggattccccatatgaaccagttaacagcagattgtcagatatattccgggtggtcccattcatatcagatgtttttcagcaagtggagcacattcccaaagggaacaactgcctggatgcagcgaaggcctgcaacctcgacgacatttgcaagaagtacaggtcggcgtacatcaccccgtgcaccaccagcgtgtccaacgatgtctgcaaccgccgcaagtgccacaaggccctccggcagttctttgacaaggtcccggccaagcacagctacggaatgctcttctgctcctgccgggacatcgcctgcacagagcggaggcgacagaccatcgtgcctgtgtgctcctatgaagagagggagaagcccaactgtttgaatttgcaggactcctgcaagacgaattacatctgcagatctcgccttgcggatttttttaccaactgccagccagagtcaaggtctgtcagcagctgtctaaaggaaaactacgctgactgcctcctcgcctactcggggcttattggcacagtcatgacccccaactacatagactccagtagcctcagtgtggccccatggtgtgactgcagcaacagtgggaacgacctagaagagtgcttgaaatttttgaatttcttcaaggacaatacatgtcttaaaaatgcaattcaagcctttggcaatggctccgatgtgaccgtgtggcagccagccttcccagtacagaccaccactgccactaccaccactgccctccgggttaagaacaagcccctggggccagcagggtctgagaatgaaattcccactcatgttttgccaccgtgtgcaaatttacaggcacagaagctgaaatccaatgtgtcgggcaatacacacctctgtatttccaatggtaattatgaaaaagaaggtctcggtgcttccagccacataaccacaaaatcaatggctgctcctccaagctgtggtctgagcccactgctggtcctggtggtaaccgctctgtccaccctattatctttaacagaaacatcatagctgcattaaaaaaatacaatatggacatgtaaaaagacaaaaaccaagttatctgtttcctgttctcttgtatagctgaaattccagtttaggagctcagttgagaaacagttccattcaactggaacatttttttttttccttttaagaaagcttcttgtgatccttcggggcttctgtgaaaaacctgatgcagtgctccatccaaactcagaaggctttgggatatgctgtattttaaagggacagtttgtaacttgggctgtaaagcaaactggggctgtgttttcgatgatgatgatcatcatgatcatgatgattttaacagttttacttctggcctttcctagctagagaaggagttaatatttctaaggtaactcccatatctcctttaatgacattgatttctaatgatataaatttcagcctacattgatgccaagcttttttgccacaaagaagattcttaccaagagtgggctttgtggaaacagctggtactgatgttcacctttatatatgtactagcattttccacgctgatgtttatgtactgtaaacagttctgcactcttgtacaaaagaaaaaaccacccggaattc

SEQ ID NO: 1135 - DNA, 3051 bp, Homo sapiens
gggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttaccataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagcttttttttttttttttaactctaacacccttcagaaatttctaactactttgtaactgcatggcttaacctggtgataaaagcagttattaaaagtctacgttttccaaaaaaaaaaaaaaa

SEQ ID NO: 1136 - DNA, 1726 bp, Homo sapiens
ccagattctaaatatcaggaaagacgctgtgggaaaatagcaggccaaaagttcttagtaaactgcagccagggagactcagactagaatggaggtagaaagaactgatgcagagtgggtttaattctaagcctttttgtggctaagttttgttgttgttaacttattgaatttagagttgtattgcactggtcatgtgaaagccagagcagcaccagtgtcaaaatagtgacagagagttttgaataccatagttagtatatatgtactcagagtatttttattaaagaaggcaaagagcccggcatagatcttatcttcatcttcactcggttgcaaaatcaatagttaagaaatagcatctaagggaacttttaggtgggaaaaaaaatctagagatggctctaaatgactgtttccttctgaacttggaggtggaccatttcatgcactgcaacatctccagtcacagtgcggatctccccgtgaacgatgactggtcccacccggggatcctctatgtcatccctgcagtttatggggttatcattctgataggcctcattggcaacatcactttgatcaagatcttctgtacagtcaagtccatgcgaaacgttccaaacctgttcatttccagtctggctttgggagacctgctcctcctaataacgtgtgctccagtggatgccagcaggtacctggctgacagatggctatttggcaggattggctgcaaactgatcccctttatacagcttacctctgttggggtgtctgtcttcacactcacggcgctctcggcagacagatacaaagccattgtccggccaatggatatccaggcctcccatgccctgatgaagatctgcctcaaagccgcctttatctggatcatctccatgctgctggccattccagaggccgtgttttctgacctccatcccttccatgaggaaagcaccaaccagaccttcattagctgtgccccatacccacactctaatgagcttcaccccaaaatccattctatggcttcctttctggtcttctacgtcatcccactgtcgatcatctctgtttactactacttcattgctaaaaatctgatccagagtgcttacaatcttcccgtggaagggaatatacatgtcaagaagcagattgaatcccggaagcgacttgccaagacagtgctggtgtttgtgggcctgttcgccttctgctggctccccaatcatgtcatctacctgtaccgctcctaccactactctgaggtggacacctccatgctccactttgtcaccagcatctgtgcccgcctcctggccttcaccaactcctgcgtgaacccctttgccctctacctgctgagcaagagtttcaggaaacagttcaacactcagctgctctgttgccagcctggcctgatcatccggtctcacagcactggaaggagtacaacctgcatgacctccctcaagagtaccaacccctccgtggccacctttagcctcatcaatggaaacatctgtcacgagcggtatgtctagattgacccttgattttgccccctgagggacggttttgctttatggctagacaggaacccttgcatccattgttgtgtctgtgccctccaaagagccttcagaatgctcctgagtggtgtaggtgggggtggggaggcccaaatgatggatcaccattatattttgaaagaagc

SEQ ID NO: 1137 - DNA, 660 bp, Homo sapiens
atgtccgagactgcgcctgccgcgcccgctgctccggcccctgccgagaagactcccgtgaagaagaaggcccgcaagtctgcaggtgcggccaagcgcaaagcgtctgggcccccggtgtccgagctcattactaaagctgttgccgcctccaaggagcgcagcggcgtatctttggccgctctcaagaaagcgctggcagccgctggctatgacgtggagaaaaacaacagccgcatcaagctgggtctcaagagcctggtgagcaagggcaccctggtgcagaccaagggcaccggcgcgtcgggttccttcaaactcaacaagaaggcggcctctggggaagccaagcctaaggctaaaaaggcaggcgcggccaaggccaagaagccagcaggagcggcgaagaagcccaagaaggcgacgggggcggccacccccaagaagagcgccaagaagaccccaaagaaggcgaagaagccggctgcagctgctggagccaaaaaagcgaaaagcccgaaaaaggcgaaagcagccaagccaaaaaaggcgcccaagagcccagcgaaggccaaagcagttaaacccaaggcggctaaaccaaagaccgccaagcccaaggcagccaagccaaagaaggcggcagccaagaaaaagtag

SEQ ID NO: 1138 - DNA, 681 bp, Homo sapiens
atgtcggaaaccgctcctgccgagacagccaccccagcgccggtggagaaatccccggctaagaagaaggcaactaagaaggctgccggcgccggcgctgctaagcgcaaagcgacggggcccccagtctcagagctgatcaccaaggctgtggctgcttctaaggagcgcaatggcctttctttggcagcccttaagaaggccttagcggccggtggctacgacgtggagaagaataacagccgcattaagctgggcctcaagagcttggtgagcaagggcaccctggtgcagaccaagggcactggtgcttctggctcctttaaactcaacaagaaggcggcctccggggaagccaagcccaaagccaagaaggcaggcgccgctaaagctaagaagcccgcgggggccacgcctaagaaggccaagaaggctgcaggggcgaaaaaggcagtgaagaagactccgaagaaggcgaagaagcccgcggcggctggcgtcaaaaaggtggcgaagagccctaagaaggccaaggccgctgccaaaccgaaaaaggcaaccaagagtcctgccaagcccaaggcagttaagccgaaggcggcaaagcccaaagccgctaagcccaaagcagcaaaacctaaagctgcaaaggccaagaaggcggctgccaaaaagaagtag

SEQ ID NO: 1139 - DNA, 648 bp, Homo sapiens
atgtctgaaacagtgcctcccgcccccgccgcttctgctgctcctgagaaacctttagctggcaagaaggcaaagaaacctgctaaggctgcagcagcctccaagaaaaaacccgctggcccttccgtgtcagagctgatcgtgcaggctgcttcctcctctaaggagcgtggtggtgtgtcgttggcagctcttaaaaaggcgctggcggccgcaggctacgacgtggagaagaacaacagccgcattaagctgggcattaagagcctagtaagcaagggaacgttggtgcagacaaagggtaccggagcctcgggttccttcaagctcaacaagaaggcgtcctccgtggaaaccaagcccggcgcctcaaaggtggctacaaaaactaaggcaacgggtgcatctaaaaagctcaaaaaggccacgggggctagcaaaaagagcgtcaagactccgaaaaaggctaaaaagcctgcggcaacaaggaaatcctccaagaatccaaaaaaacccaaaactgtaaagcccaagaaagtagctaaaagccctgctaaagctaaggctgtaaaacccaaggcggccaaggctagggtgacgaagccaaagactgccaaacccaagaaagcggcacccaagaaaaagtaa

SEQ ID NO: 1140 - DNA, 1011 bp, Homo sapiens
gatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacattctaatgcatatttataagagaagtttaacaagtatttattcccataaaaaaaaaaaaaa

SEQ ID NO: 1141 - DNA, 1968 bp, Homo sapiens
aattccgccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcgaggggtctggacgcacagaacacatcaacatccaccagctgaggaacaaagtatcagaggagcatgatgttctcaggaagaaagagatggagtcagggcccaaagcatcccatggctatggaggtcggtttggagtagaaagagaccgaatggacaagagtgcagtgggccatgagtatgttgccgaggtggagaagcactcttctcagacggatgctgccaaaggctttgggggcaagtacggagttgagagggacagggcagacaagtcagcagtcggctttgattataaaggagaagtggagaagcatacatctcagaaagattactctcgtggctttggtggccggtacggggtggagaaggataaatgggacaaagcagctctgggatatgactacaagggagagacggagaaacacgagtcccagagagattatgccaagggctttggtggccagtatggaatccagaaggaccgagtggataagagcgctgtcggcttcaatgaaatggaggccccgaccacagcttataagaagacgacgcccatagaagccgcttctagtggtgcccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggcctggcctccagttgggactcctccatcatcagagtctgagcctgtgagaaccagcagggaacacccagtgcccttgctgcccattaggcagactctcccggaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccagagggggactatgaggaggtgctcgagcctgaagattcttctttttcttctgctctggctggatcatcaggctgcccggctggggctggggctggggctgtggctctggggatctcagctgtggctctatatgattaccaaggagagggaagtgatgagctttcctttgatccggacgacgtaatcactgacattgagatggtggacgagggctggtggcggggacgttgccatggccactttggactcttccctgcaaattatgtcaagcttctggagtgactagagctcactgtctactgcaactgtgatttcccatgtccaaagtggctctgctccaccccctccctattcctgatgcaaatgtctaaccagatgagtttctggacagacttccctctcctgcttcattaagggcttggggcagagacagcatggggaaggaggtccccttccccaagagtcctctctatcctggatgagctcatgaacatttctcttgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgtgaaccttctttctgttcagtcctaaaattcgaaataaagtgagactatggttcacctgtaaaaaaaaaaaaggaatt

SEQ ID NO: 1142 - DNA, 3837 bp, Homo sapiens
tcagacattgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcataccatagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaagcccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttgtggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtacaagtatattttctatcttctggtgacttgagcttgagctctgacaggcatgggcctctccgaccttcatcactattcttaggataatgctggcgggcagagatgatcaatcatcatattaaatcataatgagccc

SEQ ID NO: 1143 - DNA, 1633 bp, Homo sapiens
cgtggaggcagctagcgcgaggctggggagcgctgagccgcgcgtcgtgccctgcgctgcccagactagcgaacaatacagtcgggatggctaaaggtgaccccaagaaaccaaagggcaagacgtccgcttatgccttctttgtgcagacatgcagagaagaacataagaagaaaaacccagaggtccctgtcaattttgcggaattttccaagaagtgctctgagaggtggaagacggtgtccgggaaagagaaatccaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaacaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatatttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttagaactcttctctactataacagtcaatttctgactcacagcagtgaacaaacccccactccgttgtatttggagactggcctccctataaatgtg

SEQ ID NO: 1144 - DNA, 2387 bp, Homo sapiens
gctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggacaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtga

SEQ ID NO: 1145 - DNA, 3804 bp, Homo sapiens
cttcttgtaagagagtgctaggcacatagccccctcctattcctaatcctcccaccaaagaaagaggcacagagttcattacttagtgggggccagctgtgatcggccaactgccagctgccttaaaaaggaagaccagtgatgctaggatggagtgaaacccaagaggaagtgccatcatgaggaatcaatgagagatctgtgaagagagagggctgggtgggagcccagaaggatagaacctggaagatcaatatctcccgtgagggaaataacaatggagccaggttctaagtcagtgtctaggtcagactggcaacctgaaccacaccagaggcctataaccccgctagagcctgggccagaaaagacacccatagcccagccagaatcgaagactctgcagggatccaatacccaacagaagcctgcttcaaaccaaagacccctcacccagcaggagacccctgcacaacatgatgctgaatcccagaaggaacctagagcccaacaaaaatctgcttcacaagaggaatttcttgccccacagaagcccgcaccacagcaatcaccttacatccaaagggtgctgctcactcaacaggaagctgcctcccagcagggacctgggctaggaaaagaatctataactcaacaggagccagcattgagacaaagacatgtagcccagccagggcctgggccaggagagccacctccagctcaacaagaagctgaatcaacacctgcggcccaggctaaacctggagccaaaagggagccatctgccccgactgaatctacatcccaagagacacctgaacagtcagacaagcaaacaacgccagtccagggagccaaatccaagcagggatctttgacagagctgggatttctaacaaaacttcaggaactatccatacagcgatcagccctagagtggaaggcactttctgagtgggtcgcagattctgagtcagaatcagatgtgggatcatcttcagacacagattctccagccacgatgggtggaatggtggcccagggagtgaagctaggcttcaaaggaaaatctggttataaagtgatgtcaggatacagtgggacgtcgccacatgagaaaaccagtgctcggaatcacagacactaccaggatacagcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccagttcacgcctgccatccggccattcctgcagaccatctccattgggctggtgtccttcggggagcactacaaacgcaacgagacaggcctcagtgtggccgccagctctctcttcaccagcggccgctttgccatcgaccccgagctgcgtggggctgagtttgagcggatcacacagaacctggacgtgcacttctggaaagccttctggaacatcaccgagatggaagtgctatcgtctctggccaacatggcatcggccaccgtgagggtaagccgcctgctcagcctgccacccgaagcctttgagatgccactgactgccgaccccacgctcacggtcaccatctcacccccactggcccacacaggccctgggcccgtcctcgtcaggctcatctcctatgacctgcgtgaaggacaggacagtgaggagctcagcagcctgataaagtccaacggccaacggagcctggagctgtggccgcgcccccagcaggcaccccgctcgcggtccctgatagtgcacttccacggcggtggctttgtggcccagacctccagatcccacgagccctacctcaagagctgggcccaggagctgggcgcccccatcatctccatcgactactccctggcccctgaggcccccttcccccgtgcgctggaggagtgcttcttcgcctactgctgggccatcaagcactgcgccctccttggctcaacaggggaacgaatctgccttgcgggggacagtgcaggcgggaacctctgcttcaccgtggctcttcgggcagcagcctacggggtgcgggtgccagatggcatcatggcagcctacccggccacaatgctgcagcctgccgcctctccctcccgcctgctgagcctcatggaccccttgctgcccctcagtgtgctctccaagtgtgtcagcgcctatgctggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcagagccgatgcgccgcagtgtgtctgaagcagcactggcccagccccagggcccactgggcacggattccctcaagaacctgaccctgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgagggtttccacccccgacgctccagccagggtgccacacagatgcccctctactcctcacccatagtcaagaaccccttcatgtcgccgctgctggcacccgacagcatgctcaagagcctgccacctgtgcacatcgtggcgtgcgcgctggaccccatgctggacgactcggtcatgctcgcgcggcgactgcgcaacctgggccagccggtgacgctgcgcgtggtggaggacctgccgcacggcttcctgaccctagcggcgctgtgccgcgagacgcgccaggccgcagagctgtgcgtggagcgcatccgcctcgtcctcactcctcccgccggagccgggccgagcggggagacgggggctgcgggggtagacgggggctgcggggggcgacactaaaagcctgttgttcccatctgcgccggcctccgtcatgaatgccttccgggccgggcggaaggggacgcgggctgtgcttacttaagtcgggggtggcaagggggcggggcgggggccgaaagctgagaccctcgccacggggagggggacgcgcacacacaccggtcaccgagacggctggacctgcacgccaccgctgccttttgctgctgctgctgcggcgaccgccgcagggacggggactggccctcccttgcaggtcggtttggtttgttgtaaataaaagtatttaatta

SEQ ID NO: 1146 - DNA, 3225 bp, Homo sapiens
ggcggcagcgccctgccgacgccggggagggacgcaggcaggcggcgggcagcgggaggcggcaccccggtgctccccgcggctctcggcggagccccgccgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggatttgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtgcgagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacagttcaagttgacttgggatatatcattcctcaacatgaaacttttcatgaatgggagaagaacctatttttgttgtggtacaacagttgagagcacgaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaaacataaaatgatttatctggtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttcatgttctatgttttgttttgtgtgtagcctgactgttttataatttgggagttctcgatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 1147 - DNA, 1599 bp, Homo sapiens
gtggtgcgccgcccgggcgaggatgcggctgttccggtggctgctgaagcagccggtgcccaagcagatcgagcgctactcgcgcttttcgccgtcgccgctctccatcaaacaattcctggacttcgggagagataatgcatgtgagaaaacttcatatatgtttctacgaaaggaacttcctgtgcggctggctaacacaatgagagaagttaatcttctgccggataatttacttaaccgcccttcagtgggattggttcagagttggtatatgcagagttttcttgaacttttagaatatgaaaataagagccctgaggatccacaggtcttggataactttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacacacttctgtttgggggtgacactaatcctgttcatcctaaacacataggaagtatcgatcccacctgtaacgtggcggatgtggtgaaagatgcatatgaaacagccaagatgctgtgtgaacagtattacctggtagctccagagctggaagttgaagaattcaatgccaaagcgccagacaaacctattcaggtggtttatgtgccctcacatctgtttcatatgctatttgagttgttcaagaactcaatgagagcgacagttgaactctatgaagacagaaaagagggctaccctgctgttaaaaccctcgttactttgggtaaagaagacttatccattaagatcagtgacctaggtggtggtgtcccacttcgaaaaatagatcgtctttttaactacatgtattctactgctcctaggcccagcctggagcctaccagagctgcccctttggctggatttggttatggtttgccaatttcccgtctgtatgctagatattttcaaggagatctgaaactgtattccatggaaggagtgggtactgatgctgtcatttatttgaaggctctttcaagtgagtcatttgagagacttccagtttttaataagtccgcatggcgccattacaagaccacgcctgaagccgatgattggagcaatcccagcagtgaacccagggatgcttcaaaatacaaagcaaaacagtaatataccaccttgatttccattacaaagtatctgatttgtctgaataaaggtgtcccactcactgttccaggaattcttgcagtgtagaggtattcacaacagcaagcagggatttggcctgccatcaattttatttaaaaagcaattaagtttgcagtttgtcctcataaacgttgtaggttgaaactgaaaaataagttaaaatgatcaatcaagataaaaggtgatctatccatccaatggaatattatttggccttaaaaaggaaggacatctgatatgtgctgcaacatgggtgaatcttgaagtcattatgctaagtgaaataaaccagacataaaaggacaaatacatcg

SEQ ID NO: 1148 - DNA, 860 bp, Homo sapiens
aaaaggccggcggaacagccagaggagcagagaggcaaagaaacattgtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggtttgtattcggttcccaggggttgagagcatgcctgtgggagtcatggacatgaagggatgctgcaatgtaggaaggagagctctttgtgaatgtgaggtgttgctaaatatgttattgtggaaagatgaatgcaatagtaggactgctgacattttgcagaaaatacattttatttaaaatctccaaaaaaaaaaa

SEQ ID NO: 1149 - DNA, 1493 bp, Homo sapiens
ttcctttcatgttcagcatttctactccttccaagaagagcagcaaagctgaagtagcagcaacagcaccagcagcaacagcaaaaaacaaacatgagtgtgaagggcatggctatagccttggctgtgatattgtgtgctacagttgttcaaggcttccccatgttcaaaagaggacgctgtctttgcataggccctggggtaaaagcagtgaaagtggcagatattgagaaagcctccataatgtacccaagtaacaactgtgacaaaatagaagtgattattaccctgaaagaaaataaaggacaacgatgcctaaatcccaaatcgaagcaagcaaggcttataatcaaaaaagttgaaagaaagaatttttaaaaatatcaaaacatatgaagtcctggaaaagggcatctgaaaaacctagaacaagtttaactgtgactactgaaatgacaagaattctacagtaggaaactgagacttttctatggttttgtgactttcaacttttgtacagttatgtgaaggatgaaaggtgggtgaaaggaccaaaaacagaaatacagtcttcctgaatgaatgacaatcagaattccactgcccaaaggagtccagcaattaaatggatttctaggaaaagctaccttaagaaaggctggttaccatcggagtttacaaagtgctttcacgttcttacttgttgtattatacattcatgcatttctaggctagagaaccttctagatttgatgcttacaactattctgttgtgactatgagaacatttctgtctctagaagttatctgtctgtattgatctttatgctatattactatctgtggttacagtggagacattgacattattactggagtcaagcccttataagtcaaaagcatctatgtgtcgtaaagcattcctcaaacattttttcatgcaaatacacayttctttccccaaatatcatgtagcacatcaatatgtagggaaacattcttatgcatcatttggtttgttttataaccaattcattaaatgtaattcataaaatgtactatgaaaaaaattatacgctatgggatactggcaacagtgcacatatttcataaccaaattagcagcaccggtcttaatttgatgtttttcaacttttattcattgagatgttttgaagcaattaggatatgtgtgtttactgtactttttgttttgatccgtttgtataaatgatagcaatatcttggacacatttgaaatacaaaatgtttttgtctaccaaagaaaaatgttgaaaaataagcaaatgtatacctagcaatcacttttactttttgtaattctgtctcttagaaaaatacataatctaatcaatttctttgttcatgcctatatactgtaaaatttaggtatactcaagactagtttaaagaatcaaagtcatttttttctctaataaactaccacaacctttcttttttaaaaaaaaaaa

SEQ ID NO: 1150 - DNA, 2038 bp, Homo sapiens
gcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatcatcgaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggttttctgttggataattagcagtttagaatggaggaagaacaacaaagacatgctttccattttttcctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaaggcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaaaaaaaaaaaaaaaaaaaaa

SEQ ID NO: 1151 - DNA, 4534 bp, Homo sapiens
gtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgtagagatagagtttcatcatgttggccaggatggtctcgatctcctgaccttgtgatccgcctgcctcggcctcccaaagtgctggattacaggtgtgagccaccacgatcagcctctagtgtttaaaaaagaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttgtggaggaaattgaacagatgaataatttgttccagcaaaaacagagggagctcgtcctggctgtgtcaaaagtagaagaactgaccaggcagctagagatgctcaagaacggcaggatcgacagccaccatgacaatcagtctgcagtggctgagcttgatcgcctctataaggagctgcagctaagaaacaaattgaatcaagagcagaatgccaagctacaacaacagagggagtgtttgaataagcgtaattcagaagtggcagtcatggataagcgtgttaatgagctgagggaccggctgtggaagaagaaggcagctctacagcaaaaagaaaatctaccagtttcatctgatggaaatcttccccagcaagccgcgtcagccccaagccgtgtggctgcagtaggtccctatatccagtcatctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggctctaaaatccatccagttggccctgattggagtccttcaaatgcagatcttttcccaagccaaggctctgcttctgtacctcaaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcaggttgcaaataaaaatgtggctaaagtaccacctcctgttcctacaaaaccaaaacagattaatttgccttattttggacaaactaatcagccaccttcagacattaagccagacggaagttctcagcagttgtcaacagttgttccgtccatgggaactaaaccaaaaccagcagggcagcagccgagagtgctgctatctcccagcataccttcggttggccaagaccagaccctttctccaggttctaagcaagaaagtccacctgctgctgccgtccggccctttactccccagccttccaaagacaccttacttccacccttcagaaaaccccagaccgtggcagcaagttcaatatattccatgtatacgcaacagcaggcgccaggaaaaaacttccagcaggctgtgcagagcgcgttgaccaagactcataccagagggccacacttttcaagtgtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctgcccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggccttggggctcactgaaggctcgaaggcactgcacaccttgtatattgtcagtgaagaacgttagttggttgtcagtgaacaataactttattatatgagtttttgtagcatcttaagaattatacatatgtttgaaatattgaaactaagctacagtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgct

SEQ ID NO: 1152 - DNA, 4517 bp, Homo sapiens
gcggagccaaggcacacgggtctgacccttgggccggcccggagcaagtgacacggaccggtcgcctatcctgaccacagcaaagcggcccggagcccgcggaggggacctgacgggggcgtaggcgccggaaggctgggggccccggagccgggccggcgtggcccgagttccggtgagcggacggcggcgcgcgcagatttgataatgggctgcattaaaagtaaagaaaacaaaagtccagccattaaatacagacctgaaaatactccagagcctgtcagtacaagtgtgagccattatggagcagaacccactacagtgtcaccatgtccgtcatcttcagcaaagggaacagcagttaatttcagcagtctttccatgacaccatttggaggatcctcaggggtaacgccttttggaggtgcatcttcctcattttcagtggtgccaagttcatatcctgctggtttaacaggtggtgttactatatttgtggccttatatgattatgaagctagaactacagaagacctttcatttaagaagggtgaaagatttcaaataattaacaatacggaaggagattggtgggaagcaagatcaatcgctacaggaaagaatggttatatcccgagcaattatgtagcgcctgcagattccattcaggcagaagaatggtattttggcaaaatggggagaaaagatgctgaaagattacttttgaatcctggaaatcaacgaggtattttcttagtaagagagagtgaaacaactaaaggtgcttattccctttctattcgtgattgggatgagataaggggtgacaatgtgaaacactacaaaattaggaaacttgacaatggtggatactatatcacaaccagagcacaatttgatactctgcagaaattggtgaaacactacacagaacatgctgatggtttatgccacaagttgacaactgtgtgtccaactgtgaaacctcagactcaaggtctagcaaaagatgcttgggaaatccctcgagaatctttgcgactagaggttaaactaggacaaggatgtttcggcgaagtgtggatgggaacatggaatggaaccacgaaagtagcaatcaaaacactaaaaccaggtacaatgatgccagaagctttccttcaagaagctcagataatgaaaaaattaagacatgataaacttgttccactatatgctgttgtttctgaagaaccaatttacattgtcactgaatttatgtcaaaaggaagcttattagatttccttaaggaaggagatggaaagtatttgaagcttccacagctggttgatatggctgctcagattgctgatggtatggcatatattgaaagaatgaactatattcaccgagatcttcgggctgctaatattcttgtaggagaaaatcttgtgtgcaaaatagcagactttggtttagcaaggttaattgaagacaatgaatacacagcaagacaaggtgcaaaatttccaatcaaatggacagctcctgaagctgcactgtatggtcggtttacaataaagtctgatgtctggtcatttggaattctgcaaacagaactagtaacaaagggccgagtgccatatccaggtatggtgaaccgtgaagtactagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagcccttttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaaatgtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgccgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatggtctcgatctcctgaccttgtgatctgcccgcctcggcctcccaaagtgctgggattacaggtgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcgtatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacc

SEQ ID NO: 1153 - DNA, 2197 bp, Homo sapiens
tcttgtcttgaagaagtagaacggtgcccgagaaacgtttttccccttcgagactcaggaggatgaaagtcatcacttgtgaaatagcctggcacaacaaggagcccgtgtacagcctggacttccagcatgggacggctgggaggatccacagactggcgtctgccggcgtggacaccaatgtcaggatctggaaggtagaaaagggaccagatggaaaagccatcgtggaatttttgtccaatcttgctcgtcataccaaagccgtcaatgttgtgcgtttttctccaactggggaaattttagcatcgggaggagatgatgctgtcatcctattgtggaaggtgaatgataacaaggagccggagcagatcgcttttcaggatgaggacgaggcccagctgaacaaggagaactggacggttgtgaagactctgcggggccacttagaagatgtgtatgatatttgctgggcaactgatgggaatttaatggcttctgcctctgtggataacacagccatcatatgggatgtcagcaaaggacaaaagatatcaatttttaatgaacataaaagttatgtccaaggagtaacctgggaccctttgggtcaatatgttgctactctgagctgtgacagggtgctgcgagtatacagtatacagaagaagcgtgtggctttcaatgtttcgaagatgctgtctggaataggggctgaaggagaggcaagaagctaccggatgtttcacgacgacagcatgaagtctttcttccgtagactgagtttcactcccgacggatctttgcttctcacgccagctggatgtgtggaatctggtgaaaatgtaatgaataccacttatgttttctccaggaagaatcttaaaaggcccatcgctcatcttccatgtcctggaaaagccactcttgctgttcgctgctgtccggtctactttgaactgaggccagtggtggaaacaggtgtggagctgatgagtctgccctaccgcctggtgtttgctgtggcctcggaggattccgtgcttctgtatgacacccagcagtccttcccttttggttacgtgtctaatatacattaccacaccctcagtgacatttcatggtccagcgatggtgccttcctggccatttcttccacggacggttactgctcatttgtgacatttgagaaagatgaacttggaattcctttgaaagagaagccagttttgaacatgagaactcctgatacagcaaagaaaaccaagagtcagacacatcgagggtcttcgccaggacccagaccggtagagggaacccctgccagcagaacccaagaccccagcagccccggcacgactccccctcaggccagacaggccccagccccaacagtcatcagggaccctccctccatcactcctgctgtcaaaagccccttgccggggccttcggaggagaagaccctgcagcccagtagtcaaaacacaaaagcccacccatcccggagggtcactctgaacacactgcaagcctggagcaagacaacaccccggagaataaacttaacacccttaaagacggacactccaccaagttctgtaccaaccagtgtgatttccaccccttctacagaagaaattcagtcagagacgcctggagacgctcagggcagtcccccagagctaaagcggcccagactcgatgaaaacaaaggaggcacggaaagtctggacccttgatgggacctcggcttctgctcgaagcctaccaggctcccggtgtgtgcagggagacggtaaagctggaggtgcctgagaccagggcttccatggagcgggacacactgtaaatggatttctataacagaagtgacatgtgtactgatttttctccagaaatatggatgctgttgtattcagtatccatttttaacttgggacatgaacgttttaacatagtaaatcctctttttgatgagtttctgaaactggagcggttcaacgttatccagtgtgaaaatcagtgagtcctccctggcatcctcgtgaaagtgcacacacttcatggagggactccttttcaataagaattaggaagatgagaaagtaatttgagattttactctgtcgaattttagagtatttgaagtgattgttagatttcacttctaaggagttgattgattaaactttgg

SEQ ID NO: 1154 - DNA, 1872 bp, Homo sapiens
atggagatccccgggagcttgtgcaagaaagtcaagctgagcaataacgcgcagaactggggaatgcagagagcaaccaatgtcacctaccaagcccatcatgtcagcaggaacaagagaggtcaggtggtggggaccagaggtggctttcgtggttgcacagtttggctaacaggcttgtctggagcgggaaagactactgtgagcatggccttggaggagtacctggtttgtcatggtattccatgctacactctggatggtgacaatattcgtcaaggtctcaataaaaatcttggctttagtcctgaagacagagaagagaatgttcgacgcatcgcagaagttgctaaactgtttgcagatgctggcttagtgtgcatcacaagtttcatatcaccttacactcaggatcgcaacaatgcaaggcaaattcatgaaggtgcaagtttaccgttttttgaagtatttgttgatgctcctctgcatgtttgtgaacagagggatgtcaaaggactctacaaaaaagcccgggcaggagaaattaaaggtttcactgggatcgattctgaatatgaaaagccagaggcccctgagttggtgctgaaaacagactcctgtgatgtaaatgactgtgtccagcaagttgtggaacttctacaggaacgggatattgtacctgtggatgcatcttatgaagtaaaagaactatatgtgccagaaaataaacttcatttggcaaaaacagatgcggaaacattaccagcactgaaaattaataaagtggatatgcagtgggtgcaggttttcgcagaaggttgggcaaccccattgaatggctttatgagagagagggagtacttgcagtgccttcattttgattgtcttctggatggaggtgtcattaacttgtcagtacctatagttctgactgcgactcatgaagataaagagaggctggacggctgtacagcatttgctctgatgtatgagggccgccgtgtggccattcttcgcaatccagagttttttgagcacaggaaagaggagcgctgtgccagacagtggggaacgacatgcaagaaccacccctatattaagatggtgatggaacaaggagattggctgattggaggagatcttcaagtcttggatcgagtttattggaatgatggtcttgatcagtatcgtcttactcctactgagctaaagcagaaatttaaagatatgaatgctgatgctgtctttgcatttcaactacgcaacccagtgcacaatggacatgccctgttaatgcaggatacccataagcaacttctagagaggggctaccggcgccctgtcctcctcctccaccctctgggctggacaaaggatgacgatgttcctttgatgtggcgtatgaagcagcatgctgcagtgttggaggaaggagttctgaatcctgagacgacagtggtggccatcttcccatctcccatgatgtatgctggaccaactgaggtccagtggcattgcagagcacggatggttgcaggagccaacttttacattgttggacgagaccctgctggcatgcctcatccagaaacagggaaggatctttatgagccaagtcatggtgccaaagtgctgacgatggcccctggtttaatcactttggaaatagttccctttcgagttgcagcttacaacaagaaaaagaagcgtatggactactatgactctgaacaccatgaagactttgaatttattttaggaacacgaatgcgcaaacttgctcgagaaggccagaaaccacctgaaggtttcatggctcccaaggcttggaccgtgctgacagaatactacaaatccttggagaaagcttag

SEQ ID NO: 1155 - DNA, 3111 bp, Homo sapiens
ggagtgcggggcgcccggcgccaggggagccgccacagccatggattgcaaagatagaccagcttttccagttaagaagttaatacaagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagaataactaagaaattcgtcaaaggctctacagagaagaacaagctcagactgcaaagagatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggaggctaaacttgaggaaaaaaggaaaaaggaagaagagaaacggttaagagaagaagagaagcgcattaaagcagagaaggccgaaatcacgaggttcttccagaaaccaaagactccacaggcccccaagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacgaagctcctggactatgaggtggacagtgatgaggagtgggaagaagaggagcctggggagtccctgtcccacagtgagggggatgatgatgacgacatgggagaggatgaagatgaggacgatggtttctttgtgccccatgggtacctgtctgaggacgaaggtgtgacagaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagatcctggcccagctgctgccgctcctgcacggcaatgtgaacgggagcaaggtcatcatccgggagttccaggagcactgccgccggggactgctcagcaaccacaccggcagcccgcggacgccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccagattggtgctgaagacatggacggcttccaggcagacacggaggaggaggaagaggaggagggcgactgtatgatcgtggatgtcccggatgctgtggaggtccaagccccgtgtggagccgcttccggagctgggggtggtgtgggggtggacaccggcaaggccaccctgaccgcgagcccactgggtgcatcctgagagcaggggtgacgtatgtagaacgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcctattggggaagctgcgggcacagga

SEQ ID NO: 1156 - DNA, 2177 bp, Homo sapiens
gcactagggggcccggcctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgcgccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactatt

SEQ ID NO: 1157 - DNA, 4086 bp, Homo sapiens
tttttatttttttcgagtgaaggacccggagccgaaacaccggtagagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatg

SEQ ID NO: 1158 - DNA, 1711 bp, Homo sapiens
gcctcccggcgctccctccccgactcctaagtccttcggccgccaccatgtccgcctcggctgtcttcattctggacgttaagggcaagccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctcttcgagctcactggccgcagcaagaacaaatcagtagagctggaggatgtaaaattccaccagtgcgtgcggctctctcgctttgacaacgaccgcaccatctccttcatcccgcctgatggtgactttgagctcatgtcataccgcctcagcacccaggtcaagccactgatctggattgagtctgtcattgagaagttctcccacagccgcgtggagatcatggtcaaggccaaggggcagtttaagaaacagtcagtggccaacggtgtggagatatctgtgcctgtacccagcgatgccgactcccccagattcaagaccagtgtgggcagcgccaagtatgtgccggagagaaacgtcgtgatttggagtattaagtctttcccggggggcaaggagtacttgatgcgagcccactttggcctccccagtgtggaaaaggaagaggtggagggccggccccccatcggggtcaagtttgagatcccctacttcaccgtctctgggatccaggtccgatacatgaagatcattgagaaaagtggttaccaggccctgccctgggttcgctacatcacccagagtggcgattaccaacttcgtaccagctagaagggagaagagatgggggcttgaacacggggcttccttacagccccggatgcagattttagagggagggcaggtgcgggctgtgtgtgtctgtgtgagggcaggtcctggacttggcagtttcttgctcccagcacccgccccttcctcacctcttccttattccataggctgggagagaaactctctgcttccctcgcccttggagctttccccatccccctgattttatatgaagaaatagaagaggggcttgaagtccccctcgcgagtgccttcttgcaattacctgccttagcgggtgttgcgggtccctccttcacagccgctgagcccagaggtcccgctggcccctcctctgaattttaggatgtcattaaaaagatgaatct

SEQ ID NO: 1159 - DNA, 2617 bp, Homo sapiens
cgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcggatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgtt

SEQ ID NO: 1160 - DNA, 1089 bp, Homo sapiens
atgctggtcatggcgccccgaaccgtcctcctgctgctctcggcggccctggccctgaccgagacctgggccggctcccactccatgaggtatttctacaccgccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagtggatgtatggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtggaaaaggagggagctactctcaggctgcgtccagcgacagtgcccagggctctgatgtgtctctcacagcttga

SEQ ID NO: 1161 - DNA, 2058 bp, Homo sapiens
cggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattggcccaaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtatatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgcctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagaaaaaaaaaaaaaaa

SEQ ID NO: 1162 - DNA, 2709 bp, Homo sapiens
gggaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtgcatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccagcttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaacacaatcaactgtgaggaaggagataaactgaaactcaccagctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtccctaaaaaaatgtacatatacctggttgaaatacaacactatacatacacaccaccatatatactagctgttaatcctatggaatgggggtattgggagtgcttttttaatttttcatagtttttttttaataaaatggcatattttgcatctacaacttctataataagaaaaaataaataaacattatcttttttgtgaaaaaaa

SEQ ID NO: 1163 - DNA, 2272 bp, Homo sapiens
caaggagccatgccagctggacacacacttcttccagggcctctggcagccaggacagagttgagaccacagctgttgagaccctgagccctgagtctgtattgctcaagaagggccttccccagcaatgacctcctcattgcttctggcctttctcctcctggctccaaccacagtggccactcccagagctggcggtcagtgtccagcatgtggggggcccaccttggaactggagagccagcgggagctgcttcttgatctggccaagagaagcatcttggacaagctgcacctcacccagcgcccaacactgaaccgccctgtgtccagagctgctttgaggactgcactgcagcacctccacggggtcccacagggggcacttctagaggacaacagggaacaggaatgtgaaatcatcagctttgctgagacaggcctctccaccatcaaccagactcgtcttgattttcacttctcctctgatagaactgctggtgacagggaggtccagcaggccagtctcatgttctttgtgcagctcccttccaataccacttggaccttgaaagtgagagtccttgtgctgggtccacataataccaacctcaccttggctactcagtacctgctggaggtggatgccagtggctggcatcaactccccctagggcctgaagctcaagctgcctgcagccaggggcacctgaccctggagctggtacttgaaggccaggtagcccagagctcagtcatcctgggtggagctgcccataggccttttgtggcagcccgggtgagagttgggggcaaacaccagattcaccgacgaggcatcgactgccaaggagggtccaggatgtgctgtcgacaagagttttttgtggacttccgtgagattggctggcacgactggatcatccagcctgagggctacgccatgaacttctgcatagggcagtgcccactacacatagcaggcatgcctggtattgctgcctcctttcacactgcagtgctcaatcttctcaaggccaacacagctgcaggcaccactggagggggctcatgctgtgtacccacggcccggcgccccctgtctctgctctattatgacagggacagcaacattgtcaagactgacatacctgacatggtagtagaggcctgtgggtgcagttagtctatgtgtggtatgggcagcccaaggttgcatgggaaaacacgcccctacagaagtgcacttccttgagaggagggaatgacctcattctctgtccagaatgtggactccctcttcctgagcatcttatggaaattaccccacctttgacttgaagaaaccttcatctaaagcaagtcactgtgccatcttcctgaccactaccctctttcctagggcatagtccatcccgctagtccatcccgctagccccactccagggactcagacccatctccaaccatgagcaatgccatctggttcccaggcaaagacacccttagctcacctttaatagaccccataacccactatgccttcctgtcctttctactcaatggtccccactccaagatgagttgacacaaccccttcccccaatttttgtggatctccagagaggcccttctttggattcaccaaagtttagatcactgctgcccaaaatagaggcttacctacccccctctttgttgtgagcccctgtccttcttagttgtccaggtgaactactaaagctctctttgcataccttcatccattttttgtccttctctgcctttctctatgcccttaaggggtgacttgcctgagctctatcacctgagctcccctgccctctggcttcctgctgaggtcagggcatttcttatccctgttccctctctgtctaggtgtcatggttctgtgtaactgtggctattctgtgtccctacactacctggctacccccttccatggccccagctctgcctacattctgattttttttttttttttttttttgaaaagttaaaaattccttaattttttattcctggtaccactaccacaatttacagggcaatatacctgatgtaatgaaaagaaaaagaaaaagacaaagctacaacagataaaagacctcaggaatgtacatctaattgacactacattgcattaatcaatagctgcactttttgcaaactgtggctatgacagtcctgaacaagaagggtttcctgtttaagctgcagtaacttttctgactatggatcatcgttcctt

SEQ ID NO: 1164 - DNA, 4906 bp, Homo sapiens
gttgctgtcgccgttgctgtcggccgaggccaccaagaggcaacgggcggcaggttgcagtggaggggcctccgctcccctcggtggtgtgtgggtcctgggggtgcctgccggcccagccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctgattaagtcacagaaatttctgaataagttggtgatcttggtggaaacggagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgtatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgccttgttgagggcgccattctgaagaaaggaactgcagcgccgatttgagggtggagatatagataataataatattaataataataatggccacatggatcgaacactcatggtgtgccaagtgctgtgctaagtgctttacgaacattcgtcatatcaggatgacctcgagagctgaggctctagcacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactcaaaacc

SEQ ID NO: 1165 - DNA, 5828 bp, Homo sapiens
cggcggcgcggtcggagggggccggcgcgcagagccagacgccgccgcttgttttggttggggctctcggcaactctccgaggaggaggaggaggagggaggaggggagaagtaactgcagcggcagcgccctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataataaactagatactgttgatcttttaaaaaaaaaaaaaaaaaaaaaaaaaaaaa

SEQ ID NO: 1166 - DNA, 1997 bp, Homo sapiens
gtactatcctccttacttttgggtcgggccctccgggaagatggcggccgtgcaggcggccgaggtgaaagtggatggcagcgagccgaaactgagcaagaatgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggatccatgccaaaagagcttctgggggaaagctcatcttctatgatcttcgaggagagggggtgaagttgcaagtcatggccaattccagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttgggctcaaagacaaggaaacaaggtatcgccagagatacttggacttgatcctgaatgactttgtgaggcagaaatttatcatccgctctaagatcatcacatatataagaagtttcttagatgagctgggattcctagagattgaaactcccatgatgaacatcatcccagggggagccgtggccaagcctttcatcacttatcacaacgagctggacatgaacttatatatgagaattgctccagaactctatcataagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaagaaactcgcaaaattcttgatgatatctgtgtggcaaaagctgttgaatgccctccacctcggaccacagccaggctccttgacaagcttgttggggagttcctggaagtgacttgcatcaatcctacattcatctgtgatcacccacagataatgagccctttggctaaatggcaccgctctaaagagggtctgactgagcgctttgagctgtttgtcatgaagaaagagatatgcaatgcgtatactgagctgaatgatcccatgcggcagcggcagctttttgaagaacaggccaaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgtta

SEQ ID NO: 1167 - DNA, 1695 bp, Homo sapiens
atggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggatgtggatgctgcctacatgaacaaggttgaactgcaagccaaggcagacactctcacagacgagatcaacttcctgagagccttgtatgatgcagagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaa

SEQ ID NO: 1168 - DNA, 1695 bp, Homo sapiens
atggccagcacatccaccaccatcaggagccacagcagcagccgccggggtttcagtgccagctcagccaggctccctggggtcagccgctctggcttcagcagcatctccgtgtcccgctccaggggcagtggtggcctgggtggcgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcactgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggtcgtctggactcggagctgagaaacatgcaggacctggtggaggacctcaagaacaaatatgaggatgaaatcaacaagcgcacagcagcagagaatgaatttgtgactctgaagaaggatgtggatgctgcctacatgaacaaggttgaactgcaagccaaggcagacactcttacagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatatgaggagattgctcagaggagcagggctgaggctgagtcctggtaccagacaaagtacgaggagctgcaggtcacagcaggcagacatggggacgacctgcgcaacaccaagcaggagattgctgagatcaaccgcatgatccagaggctgagatctgagatcgaccacgtcaagaagcagtgtgccaacctacaggctgccattgctgatgctgagcagcgtggggagatggccctcaaggatgctaagaacaagctggaagggctggaggatgccctgcagaaggccaagcaggacctggcccggctgctgaaggagtaccaggagctgatgaacgtcaagctggccctggacgtggagatcgccacctaccgcaagctgctggagggcgaggagtgcaggctgaatggcgaaggcgttggacaagtcaacatctctgtagtgcagtccaccgtctccagtggctatggcggtgccagcggtgtcggcagtggcttaggcctgggtggaggaagcagctactcctatggcagtggtcttggcgttggaggcggctttagttccagcagcggcagagccactgggggtggcctcagctctgttggaggcggcagttccaccatcaagtacaccaccacctcctcctccagcaggaagagctacaagcactga

SEQ ID NO: 1169 - DNA, 1466 bp, Homo sapiens
acggcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaaggccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggagcaggggctgcggacgatgcaggatgtggtggaggacttcaagaataagtacgaagatgaaattaaccgccgcacagctgctgagaatgagtttgtggtcctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagtgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactga

SEQ ID NO: 1170 - DNA, 1413 bp, Homo sapiens
atgaccacctgcagccgccagttcacctcctccagctccatgaagggctcctgcggcatcggaggcggcatcggggcgggctccagccgcatctcctccgtcctggccggggcctcctgccctgccagcacctacgggggcgcctctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcacgcccttttgcagattgacaatgccaggctggcagccgatgacttcaggaccaagtatgaggcacgaactggcctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcaggatgaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcagccgtcagacccggcccatcctcagagcagagctcatccagcttcagccagggccagagctcctag

SEQ ID NO: 1171 - DNA, 2442 bp, Homo sapiens
gcgggattccgggccgggccggcctgggctgcaatcaatgcggctttgtctgggacgcccacatcccagaggccattcccgggtcggcaaatcggagcgcggcggggcgcgcgggggtgagataagcggccatgtgatcccacctgggctggaaggggaggggcgccaggtgaggcggcggccggtggggcgcgggcggccacgcggggctcctgcagcatggctgtcagcaggaaggactggtccgcgctgtccagccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctggcccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttcccttgttggctgtggatctgtttggccagggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccaacaagtgcctctttgtctatgatgtcccccttctctgaggcctggacccacccatctttgtccctgggggctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctc

SEQ ID NO: 1172 - DNA, 5175 bp, Homo sapiens
acagcggagcgcagagtgagaaccaccaaccgaggcgccgggcagcgacccctgcagcggagacagagactgagcggcccggcaccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactctggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgttactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatgggcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaacgctggtaaccaggcatatggatgagttcaagcgtacacaaaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgcc

SEQ ID NO: 1173 - DNA, 1436 bp, Homo sapiens
agtgtggtcaggcggctcggactgagcaggactttccttatcccagttgattgtgcagaatacactgcctatcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgt

SEQ ID NO: 1174 - DNA, 1984 bp, Homo sapiens
gaagagaccatatttgttcgcagaggaagccgttgctttctgggatctggctacggcagaaaagacatcggctccaacaggggtgttccacagggtagctgggagttggaagagccaagaacgcctccgagctctggatttgagcttctctgcccatgggtgaagcgcccatgctcagcttgtgagcttcttcccgggagagcagccatggcactgaggaatgtgccctttcgctcagaggtcctgggctgggaccccgacagccttgctgactatttcaagaagctcaactataaggactgtgagaaggcagtgaagaagtaccacatcgatggggctcgcttcttgaacctgacagaaaatgacatccagaagttccccaagctccgggtgccgattctcagtaagttaagtcaggaaatcaacaagaacgaagagaggaggagcatcttcacacgcaaaccccaagtcccgcggtttcctgaagagacagaaagccacgaagaggacaatgggggttggtcgtcctttgaagaagacgattatgaaagtcccaatgatgaccaggatggggaggatgatggagactatgagtcccccaatgaggaggaagaggcacccgtggaagatgacgcggattatgagccgccaccctccaatgacgaggaagctctgcagaactccatcctgcctgccaagcctttccccaactccaactccatgtacatcgaccggcccccctctgggaaaaccccccagcagcctcctgtgcccccccagagaccgatggccgccctcccgcccccaccagccggccggaatcactcgccactgcccccaccccagaccaaccacgaagaacccagcagaagcagaaaccacaaaacggcaaagctccctgctccttcaatagacagaagcacgaaacctcccctagatcgttcattagctccgtttgatagagaacccttcacactaggaaagaaaccaccattttctgacaagccctcgattccagcgggaaggtcactcggggagcatttacccaagattcaaaagcctcctttaccaccgaccacggaaagacatgaaaggagcagccccctgccagggaagaagccacctgtgccaaagcatggatggggaccagacagaagagagaatgatgaagatgatgtgcatcagagacctttgccccagccagcactacttcctatgagctccaacactttcccttcaagatctactaagccaagtcccatgaaccctctcccatcctctcacatgcctggagcattctcagaaagtaacagcagttttccacagagtgcctccctgccaccatacttctctcaaggccctagcaacagaccacctatcagagccgaaggcagaaacttccccttgccacttccaaacaaacctcggcccccatcccccgcggaggaagagaattcattaaatgaagagtggtacgtttcttatattacccgaccagaggcagaagctgctcttagaaagataaaccaggatggcacatttctggtcagagacagctctaaaaaaacaacaaccaatccatatgtcctcatggtgttgtacaaagataaagtttacaacatccagatccgttatcagaaggaaagtcaagtttacttgttgggaactggactccgagggaaagaggactttctgtctgtgtcagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctccccatgaacacaagggttttatcctttcctttaaaaacagtgtttgaaatgaagactgtcaactatcccc

SEQ ID NO: 1175 - DNA, 1661 bp, Homo sapiens
tgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatatttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtg

SEQ ID NO: 1176 - DNA, 2029 bp, Homo sapiens
actcagtgttcgcgggagccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccatgtgagtggtagccgccgctgaggccgagcctgcactggggccacccagccaggcctgggggcagcctctccccagcctccccgtgccaaaaatcttttcattaaagaatgtttggaacttt

SEQ ID NO: 1177 - DNA, 2697 bp, Homo sapiens
gctgagcagtcaacagcatttcttgttccaagatcacccttctgagtacctctctggctgccaaattgccagggccttcacagtttgattccattctcagctccaagcattaggtaaacccaccaagcaatcctagcctgtgatggcgtttgacgtcagctgcttcttttgggtggtgctgttttctgccggctgtaaagtcatcacctcctgggatcagatgtgcattgagaaagaagccaacaaaacatataactgtgaaaatttaggtctcagtgaaatccctgacactctaccaaacacaacagaatttttggaattcagctttaattttttgcctacaattcacaatagaaccttcagcagactcatgaatcttacctttttggatttaactaggtgccagattaactggatacatgaagacacttttcaaagccatcatcaattaagcacacttgtgttaactggaaatcccctgatattcatggcagaaacatcgcttaatgggcccaagtcactgaagcatcttttcttaatccaaacgggaatatccaatctcgagtttattccagtgcacaatctggaaaacttggaaagcttgtatcttggaagcaaccatatttcctccattaagttccccaaagacttcccagcacggaatctgaaagtactggattttcagaataatgctatacactacatctctagagaagacatgaggtctctggagcaggccatcaacctaagcctgaacttcaatggcaataatgttaaaggtattgagcttggggcttttgattcaacggtcttccaaagtttgaactttggaggaactccaaatttgtctgttatattcaatggtctgcagaactctactactcagtctctctggctgggaacatttgaggacattgatgacgaagatattagttcagccatgctcaagggactctgtgaaatgtctgttgagagcctcaacctgcaggaacaccgcttctctgacatctcatccaccacatttcagtgcttcacccaactccaagaattggatctgacagcaactcacttgaaagggttaccctctgggatgaagggtctgaacttgctcaagaaattagttctcagtgtaaatcatttcgatcaattgtgtcaaatcagtgctgccaatttcccctcccttacacacctctacatcagaggcaacgtgaagaaacttcaccttggtgttggctgcttggagaaactaggaaaccttcagacacttgatttaagccataatgacatagaggcttctgactgctgcagtctgcaactcaaaaacctgtcccacttgcaaaccttaaacctgagccacaatgagcctcttggtctccagagtcaggcattcaaagaatgtcctcagctagaactcctcgatttggcatttacccgcttacacattaatgctccacaaagtcccttccaaaacctccatttccttcaggttctgaatctcacttactgcttccttgataccagcaatcagcatcttctagcaggcctaccagttctccggcatctcaacttaaaagggaatcactttcaagatgggactatcacgaagaccaacctacttcagactgtgggcagcttggaggttctgattttgtcctcttgtggtctcctctctatagaccagcaagcattccacagcttgggaaaaatgagccatgtagacttaagccacaacagcctgacatgcgacagcattgattctcttagccatcttaagggaatctacctcaatctggctgccaacagcattaacatcatctcaccccgtctcctccctatcttgtcccagcagagcaccattaatttaagtcataaccccctggactgcacttgctcgaatattcatttcttaacatggtacaaagaaaacctgcacaaacttgaaggctcggaggagaccacgtgtgcaaacccgccatctctaaggggagttaagctatctgatgtcaagctttcctgtgggattacagccataggcattttctttctcatagtatttctattattgttggctattctgctattttttgcagttaaataccttctcaggtggaaataccaacacatttagtgctgaaggtttccagagaaagcaaataagtgtgcttagcaaaattgctctaagtgaaggaactgtcatctgctggtgaccagaccagacttttcagattgcttcctggaactgggcagggactcactgtgcttttctgagcttcttactcctgtgagtcccagagctaaagaaccttctaggcaagtacaccgaatgactcagtccagagggtcagatgctgctgtgagaggcacagagccctttccgcatgtggaagagtgggaggaagcagagggagggactgggcagggactgccggccccggagtctcccacagggaggccattccccttctactaccgacatccctcccagcaccacacaccccgcccctgaaaggagatcatcagcccccacaatttgtcagagctgaagccagcccactacccacccccactacagcattgtgcttgggtctgggttctcagtaaatgtagccatttgagaaacttacttggggacaaagtctcaatccttattttaaatgaaaaaagaaaagaaaagcataataaatttaaaagaaaagg

SEQ ID NO: 1178 - DNA, 916 bp, Homo sapiens
acttctcgctcgacacagccagagctggaggtgggtgcccggcacggaggggcctgcggaccaatggctctgccctgcaccttagggctcgggatgctgctggccctgccaggggccttgggctcgggtggcagcgcggaggacagcgtgggctccagctctgtcaccgttgtcctgctgctgctgctgctcctactgctggccactggcctagcactggcctggcgccgcctcagccgtgactcagggggctactaccacccggcccgcctaggtgccgcgctgtggggccgcacgcggcgcctgctctgggccagccccccaggtcgctggctgcaggcccgagctgagctggggtccacagacaatgaccttgagcgacaggaggatgagcaggacacagactatgaccacgtcgcggatggtggcctgcaggctgaccctggggaaggcgagcagcaatgtggagaggcgtccagcccagagcaggtccccgtgcgggctgaggaagccagagacagtgacacggagggcgacctggtcctcggctccccaggaccagcgagcgcagggggcagtgctgaggccctgctgagtgacctgcacgcctttgctggcagcgcagcctgggatgacagcgccagggcagctgggggccagggcctccatgtcaccgcactgtagaggccggtcttggtgtcccatccctgtcacagccgctcactccccgtgcctctgcttcccaagatgccatggctggactggacccccagcccacatgaccatgcctcagactgtcacccctaccagttcccaagtccatgtgtaccccgctcaccacgggaacggccccccccaaccacaggcatcaggcaaccatttgaaataaaactccttcagcctgtgaaaaaaaaaa

SEQ ID NO: 1179 - DNA, 987 bp, Homo sapiens
ccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctc

SEQ ID NO: 1180 - DNA, 589 bp, Homo sapiens
ctccgccctctcccactctctctttccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaaaaaaaaaaaaaaaaaaaaaaaaaa

SEQ ID NO: 1181 - DNA, 595 bp, Homo sapiens
gggcaaggctgggccgggaagggcgtgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatgaaa

SEQ ID NO: 1182 - DNA, 2193 bp, Homo sapiens
ggcacgaggcgggggcggtgcatgacgcgcctcgggggcggtcctcgggcgcgcaccgctctcttacactcgggcctcagaagtccgtgccagtgaccggagcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaagtgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctggggatcttactctttcatctgataccttgttcagatttcaaaatagttgtagccttatcctggttttacagatgtgaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgtcatattactttagttctatagcatacttgcatctttaacatgctatcatagtacatttagaatgattgcctttgatttttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttttttttggtttatgtctattctaattaaatatgtataaataaagttacattttagtctgtcaaaaaaaaaaaaaaaaaaaaaaaaaaaaaaa

SEQ ID NO: 1183 - DNA, 1712 bp, Homo sapiens
aaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaatcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttcaaaaaaaaaaaaaaaaaaaa

SEQ ID NO: 1184 - DNA, 2380 bp, Homo sapiens
gccaggactccacaaggctggtcccctgccctggagcaacttaaacaggccctctggccagcctggaaccctgagatggcctccagctcaggcagcagtcctcgcccggcccctgatgagaatgagtttccctttgggtgccctcccaccgtctgccaggacccaaaggagcccagggctctctgctgtgcaggctgtctctctgagaacccgaggaatggcgaggatcagatctgccccaaatgcagaggggaagacctccagtctataagcccaggaagccgtcttcgaactcaggagaaggctcaccccgaggtggctgaggctggaattgggtgcccctttgcaggtgtcggctgctccttcaagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttggagcagagggtggtggagcttcagcagaccctggcccagaaagaccaggccctgggcaagctggagcagagcttgcgcctcatggaggaggcctccttcgatggcactttcctgtggaagatcaccaatgtcaccaggcggtgccatgagtcggcctgtggcaggaccgtcagcctcttctccccagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtcaccttcatgctgctggaccagaacaaccgtgagcacgccattgacgccttccggcctgacctaagctcagcgtccttccagaggccccagagtgaaaccaacgtggccagtggatgcccactcttcttccccctcagcaaactgcagtcacccaagcacgcctacgtgaaggacgacacaatgttcctcaagtgcattgtggagaccagcacttagggtgggcggggctcctgagggagctccaactcagaagggagctagccagaggactgtgatgccctgcccttggcacccaagacctcagggcacaaagatgggtgaaggctggcatgatccaagcaagactgaggggtcgacttcgggctggccatctggttaggatggcaggacgtgggctgggcccacaaaggcaaagggtccagaaggagacaggcagagctgctcccctctgcacggaccatgcgacactgggaggccagtgagccactccggccccgaatgttgaggtggactctcaccaaatgagaagaaaatggaaccaggcttggaaccgtaggacccaagcagagaagctctcgggctaggaagatctctgcagggccgccagggagacctggacacaggcctgctctctttttctccagggtcagaaacaggaccgggtggaagggatggggtgccagtttgaatgcagtctgtccaggctcgtcattggaggtgaacaagcaaacccagacggctccactaggacttcaaattgggggttggatttgaagacttttaagtttccttccagcccagaaagtctctcattctagcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttcccaacacgcaggagcacacccagcccccacatcctgtgcctccatcagctaaacaccacgtcacttcatgcaggtgaaacccagtcactgtgagctcccaggtgcagccagaggcacctcaagaagaagaggggcataaactttcctcttcctgcctagaggccccacctttggtgctttccagaatcccgtaacacctgattaactgaggcatccacttctttcagcagactgatcaggacctccaagccactgagcaatgtataaccccaaagggaattcaaaaaaaaaaaaaaaaa

SEQ ID NO: 1185 - DNA, 1156 bp, Homo sapiens
ggcacgaggaagagcggtcggcggggtttcttcgttgcattgcctgagaggagcggagtctgccaggtggtgtccatcatgttctctttcaacatgttcgaccaccctattcccagggtcttccaaaaccgcttctccacacagtaccgctgcttctctgtgtccatgctagcatggcctaatgacaggtcagatgtggagaaaggagggaagataattatgccaccctcggccctggaccaactcagccgacttaacattacctatcccatgctgttcaaactgaccaataagaattcggaccgcatgacgcattgtggcgtgctggaatttgtggctgatgaaggcatctgctacctcccacactggatgatgcagaacttactcttggaagaagacggcctggtccagttggagaccgtcaaccttcaagtggccacctactccaagagtaagttctgctacctcccacactggatgatgcagaacttactcttggaagaaggcggcctggtccaggtggagagcgtcaaccttcaagtggccacctactccaaattccaacctcagagcgctgacttcctggacatcaccaaccccaaagccgtattagaaaacgcacttaggaactttgcctgtctgaccaccggggatgtgattgccattaactacaatgaaaagatctacgaactgcgtgtgatggagaccaaacccgacaaggcagtgtccattcatgagtgtgacatgaacgtggactttgatgctcccctgggctacaaagaacccgaaagacaagtccagcatgaggagtcgacagaaggtgaagccgaccacagtggctatgctggagagcttggcttccgcgctttctctggatctggcaatagactggatggaaagaagaaaggggtagagcccagcccctccccaatcaagcctggagatattaaaagaggaattcccaattatgaatttaaacttggtaagataactttcatcagaaattcacgtccccttgtcaaaaaggttgaagaggatgaagctggaggcagattcgtcgctttctctggagaaggacagtcattgcgtaaaaagggaagaaagccctaagtgaggactgttggctgattggaaaataataaaagtttcatttgca

SEQ ID NO: 1186 - DNA, 3423 bp, Homo sapiens
acggccgcggtctccggaggtggcgggggtgttggggacgggtgctgcgaccggcactgcccatccgagcgggacgggcgctgagtggccgggaggagccgggtagccgcctggaggagcagtctcggggcctattattggttttttccctccgagaccgattccatctgcagagaccgcgacgccccatcctgggccgggccgcagtgccgcccgcctgagaggcgccgcccgccagccggcccgagcgaacctggagccgccgccgtgcccgccgctcttctcgcggagcctgggcggtcggcggggcctggggcctgggcttcgggcgcggcgttgcggcggccgctcctccccccgcagaacacgctgggccccgggcctggcccggccgagcgccgcgccctcctgacccgcggccgcggagtccggcccccacggcccctcgggccccggcctgccgcccggatccccgcctcctgggcggatctgagttattttttggtctccccctcccccttgagatcgcggcaccggagggccgaccccgccacctgggtcagtgcccgccccggggaagcgtccctcgttttgttcttccccgcgagctctcccgcgcgcccctctcctttctgtgcttaatggatggggttttgagtttttcccctttatttttgtcggctcttgactgggaggcccggcgcgaggctctgcgtctctgcgtccctcgtcgccgcctcgcgcccgcgcggatcccgtcacctgcttcccgccggggatggccggccagtgacggcgccgggtggcccgcgcgtggacacggggccctcgcccaagctgccaccgagccgcggcccccgccctcgacccttctctctcccgtattccgagctctctggaaagagaggagactccagggaagatgtggctgaagctttttttcttgctcctctatttcctggtcctgttcgtcctggccaggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtcatagcaaatgacagaagtcccttggtgggcaaaattcactgggagaaaatggttaaaaaggtgtcaagatttggaatacgtacaggcacatttaactgttccagtgatcccagatattgcaggagaagaggctgggtccgatccacactcattatgtctgttccacaaacaagtacttcaaaagggaaagtcatgcttaaagaatacagtggacgcaagattgaagtagagcacatttttaaatggataactgctcatgcagcttctcggatcaaaaccatttataatgctgaacacttgaaagaagaatggaataaaagtgatcagtattggttaaaaatatacctatttgcaaaccttgaccagcccccagctttcttctctgcactaagtataaagtttactggaagagttgagtttatttttgttaatgtagaaaattgggacaacaagagttatatgacagatattggcatatataatatgccatcatacatacttagaactcctgaaggaatttacaggtatggaaaccacacaggcgaatttatatcccttcaggccatggattcatttttgcgctcattacaacccgaggtaaatgatctgtttgttttgagcttggttctagttaatcttatggcttggatggacttatttattacacaaggagctaccataaagcgatttgtggttctcataagcactttagggacatataattctctattaattatttcctggctacctgtgttgggctttttacagctaccttacttagatagcttttatgaatatagcttaaaattgttgagatattccaatacaaccacactggcttcatgggtaagggcagactggatgttttactcttcacacccagccctgtttctcagtacataccttggtcatggtttactaattgattactttgagaagaagagaaggcgcaacaacaacaatgatgaagtcaatgccaataacttagaatggttatcaagtctgtgggactggtacaccagctacctcttccacccgattgcttcttttcagaactttcctgtagaatctgattgggacgaagaccctgacttattcttggagcgcttagctttccctgacctttggcttcaccctctgataccaactgattatattaaaaacttaccaatgtggcgatttaaatgtcttggagtccagtctgaagaggaaatgtcggaggggtctcaagatactgaaaatgactcggaaagtgagaacacagacactttgagtagtgagaaggaagtatttgaagataagcaaagcgtacttcacaattctccaggaacagcaagtcactgtgatgctgaggcttgttcatgtgccaataaatattgtcagaccagcccatgtgaaaggaaggggaggtcatatggatcatataacactaatgaagatatggaacctgattggttaacttggcctgctgatatgctgcactgtactgaatgtgttgtttgcctagagaattttgaaaatggatgtttgctaatggggttgccttgtggtcatgtgtttcatcagaattgcattgtgatgtggttggctgggggccgacattgttgccctgtttgccggtggccttcttataaaaaaaagcagccatatgcacaacaccagcccttgtcaaatgatgtcccatcttaaccatgtgcaatttgtcctttataagctttgagtatcttacagcttgcctttttaatgttagtcacaatgtttttgtggtttgaagtttagtttaatgttagtgcagtgacgggaaatacacattatgctaatgttgatgacagaatttatttggttgccttgtgtgttaattgaatgcatacctaattgtaaaatttttttatttacaacattggaaattcagaagttaatgtttttttgtaagcacaaaagaagtattatagaaatttatcctagcaagactttacaagataggatcaaattctaatggaattgagccggtttcttatcctaaatgtttcctccctttttacaatctctgtccagcacctcttggttaaataatgtatgctgtgagacatgaaattaaaacagacctatgaaataaattattttaaaaccag

SEQ ID NO: 1187 - DNA, 3493 bp, Homo sapiens
atgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagcgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccagtggagtatccgctgcagctgctgcacagcccccctgccccagtggtgaagaggcctggggccatggccacccaccaccccctgcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggcttccttggtgaaggggacgctgtcaccaaagccatccaggatgctcggcagctgctgcacagccacagtggggccttggatggctcccccaacacccccttccgtaaggacctcatcagcctggactcatccccagccaaggagcggctggaggacggctgtgtgcacccactggaggaagccatgctgagctgcgacatggatggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggtgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtatgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatcatttcagaaaaaaaaaaaaaaaaa

SEQ ID NO: 1188 - DNA, 2445 bp, Homo sapiens
ggaggcgaactgtgggccccggccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtgacacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggctgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattctaaattgcagaacacatcacacatttaatccaaataataaatggctgtttcaaaaaaaaaaaaaaaaaaaaaaaaaaaaaaaaaaaaaaaaaaaaaaaaaaaaaaaaaaaaaaaaaaaaaaaaaaa

SEQ ID NO: 1189 - DNA, 820 bp, Homo sapiens
cagccagcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggggtatgatatcagctttctgatcaccaacttccacacagagcagatgtacaaacacaagttggtggactttgtgatccacttcatggaggagattgacaaggagatcagtgagatgaagctgtcagtcaatgcccgtgcccgcattgtggctgaagagttccttaagaatttttaaaccatctggctggatctcgtggccttccccctcagactacccatgtctccacgaaggcgtcctggagtcactccccgagcagcgcggcggcggcagggagttgggttggggtgggcatttgatgcgggaggtgggtggtgtgcttgctagctgggcaagaaagcagcagtggacctgccccaaggccacacgtgcctggtcaggctggcttctgatgttcagtcccctgggccgggacagattttttttaacgtcttgaaacttaaactctgtgcttgtaaaaaaaaaaaaaaaaaaa

SEQ ID NO: 1190 - DNA, 1428 bp, Homo sapiens
ggcacgagggagcccagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaagagcttggagtcagccttgaaggacctcaagatcaaatgacctgtgaggaatatgttgccttcatcctaactgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaaaaaaaa

SEQ ID NO: 1191 - DNA, 1076 bp, Homo sapiens
atgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccgagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggc

SEQ ID NO: 1192 - DNA, 2972 bp, Homo sapiens
tcttcggacctaggctgccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcgtttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggaggagctgtccacttccttgaagaggagtgtctacatcgaaagtcggataggtaccagcaccagcttcgacagtggcattgctgggctctcttctatcagtcagtgtaccagcagtagccagctggatgaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaagatctcaactggattcatgtgcaagatgctgaggaggcctggaagctcctaaaagtgggtcgtaagaaccagagctttgccagcacccacctcaaccagaactccagccgcagtcacagcatcttctcaatcaggatcctacaccttcagggggaaggagatatagtccccaagatcagcgagctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcagtgaacatttggacacccaaaaggaactattggaggaaatgtatgaagaaaaactaaatatcctcaaggagtcactgacaagtttttaccaagaagagattcaggagcgggatgaaaagattgaagagctagaagctctcttgcaggaagccagacaacagtcagtggcccatcagcaatcagggtctgaattggccctacggcggtcacaaaggttggcagcttctgcctccacccagcagcttcaggaggttaaagctaaattacagcagtgcaaagcagagctaaactctaccactgaagagttgcataagtatcagaaaatgttagaaccaccaccctcagccaagcccttcaccattgatgtggacaagaagttagaagagggccagaagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacattttttattgaaaaaaaaaaaaaa

SEQ ID NO: 1193 - DNA, 625 bp, Homo sapiens
cgcagccaggagccatgggcaacatctcctctaacatctcggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtg

SEQ ID NO: 1194 - DNA, 1882 bp, Homo sapiens
gaattcgggcgtgggcgcgggggcgcggcgtgcggcacgctgcagggctgaagcggcggcggcggtggggactgcacgtagcccggcgctcggcatggctctcctggtgctcggtctggtgagctgtaccttctttctggcagtgaatggtctgtattcctctagtgatgatgtgatcgaattaactccatcaaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtgagagccacaacagaggcttcagaccattttcttttcttgggagccagtggatttttccagcagtgaagggacattctctactttcttttcttgggagccagtggatttttccagcagtgaagggacattctctacactcagatgactctaccagtggccttttaaccaagaagtagtacttgattggtcatttgaaaacactgcaacagtgaacttttgcatctcaagaaaacattgaaaaattctatgaattgttgtagccggtgaattgagtcgtattctgtcacataatattttgaagaaaacttggctgtcgaaacatttttctctctgactgctgcttgaatgttcttggaggctgtttcttatgtatgggttttttttaatgtgatcccttcatttgaatattaatggctttttccattaaagaataaattggaaaaaagaaaaaaaaaaaaaggaattc

SEQ ID NO: 1195 - DNA, 2376 bp, Homo sapiens
cgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtgg

SEQ ID NO: 1196 - DNA, 1206 bp, Homo sapiens
gttgctgtcggggagttgaaacctaattttgtggcgtagagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaagtcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaatttttttttttttaagcttatagtaaggatacattcaagcttgggttaaaaa

SEQ ID NO: 1197 - DNA, 3216 bp, Homo sapiens
gctttgccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttaattgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaaggggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccaagtttgataacattgcatgaatgccatggctaacaaagataatgcaagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaaggaaatgagttattaatgtaaattatagattaaaattctacttacatct

SEQ ID NO: 1198 - DNA, 927 bp, Homo sapiens
ggaagtttaggttaactgtcttaaatttccaaagctgtaatcattattttcattctcaaagtgatggccttgtgttttgctcctctcctccagggccagactgagcccaggttgatttcaggcggacaccaatagactccacagcagctccaggagcccagacaccggcggccagaagcaaggctaggagctgctgcagccatgtcggccctcagcctcctcattctgggcctgctcacggcagtgccacctgccagctgtcagcaaggcctggggaaccttcagccctggatgcagggccttatcgcggtggccgtgttcctggtcctcgttgcaatcgcctttgcagtcaaccacttctggtgccaggaggagccggagcctgcacacatgatcctgaccgtcggaaacaaggcagatggagtcctggtgggaacagatggaaggtactcttcgatggcggccagtttcaggtccagtgagcatgagaatgcctatgagaatgtgcccgaggaggaaggcaaggtccgcagcaccccgatgtaaccttctctgtggctccaaccccaagactcccaggcacatgggatggatgtccagtgctaccacccaagccccctccttctttgtgtggaatctgcaatagtgggctgactccctccagccccatgccggccctacccgcccttgaagtatagccagccaaggttggagctcagaccgtgtctaggttggggctcggctgtggccctggggtctcctgctcagctcagaagagccttctggagaggacagtcagctgagcacctcccatcctgctcacacgtccttccccataactatggaaatggccctaatttctgtgaaataaagactttttgtatttctggggctgaggctcagcaacagcccctcaggcttccaaaa

SEQ ID NO: 1199 - DNA, 1442 bp, Homo sapiens
ggttcccttccacgctgtgaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaagggtctgcaacttcattcttgaagtcagtgaggccaagaacccatcaattccgtacacattttggtgactttgaagagactgtcacctatcaccaagtggtgagactattgccaagcagtgagactattgccaagtggtgagaccatcaccaagcggtgagactatcacctatcgccaagtggcctgattcagcaggaagcatctcagacaccaaccactatgctgtcagcagttgcccggggctaccagggctggtttcatccctgtgctaggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattataaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccagcccaggagcctgagggggtgtctaggtgatcatttggatctggagcagagtctgccattctgccagactagcaatttgggggcttactcatgctaggcttgaggaagaagaaaaacgcttcggcattctcc

SEQ ID NO: 1200 - DNA, 894 bp, Homo sapiens
ggaagggacagtcggccgcagaccgcgctgggttgccgctgccgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtccttttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacaaaaaaaaa

SEQ ID NO: 1201 - DNA, 1512 bp, Homo sapiens
cggaagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaggaggaagagccccaggctcctcaagagagcacaccagctccccctaagaaagacatcaagggatcctacgtttccatccacagctctggcttccgggactttctgctgaagccggagctcctgcgggccatcgtggactgtggcttggagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgatgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccgccctgtgtgcaggaagttcatgcaggatcccatggaggtgtttgtggacgacgagaccaagctcacgctgcacgggctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggggggtcgctttggcaccaaaggcctagccatcacttttgtgtctgacgagaatgatgccaaaatcctcaatcacgtccaggaccggtgtgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaagtgttattatgaaatgaagaagcctcaccca

SEQ ID NO: 1202 - DNA, 5792 bp, Homo sapiens
aaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctgtggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttcttcgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatatatataaaaaaatataaatatatgtttgtttgtttgtttttttaaggaaaaacaagtcaagctagcatccagttactatatagcttggctaaattatacaagacttacaagattgattactcgacaggcttgtatttaagagataactgtgaggttaccattatgtgatgttactataaggacttttaacattggtttaacaaaccatagaggcattgaagggtttttcttagatgcctagaaaaagcacactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagccagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtatgcagtactcctgtgttctaagttcttttatgttttagtttaccctcacagcagccatagtgttaagtcattatgagcttcatcttaaagataagaaaactgaggcaaggggagattaacttactgccaaatttcaaacagttagtagtatttgagaccagtagtatggctctaatcttacccttagccctcccaaccattatgctgtactatctacccataaatacctccaggaaacattcccctcttggtaatttgtccttctatagaagcttcaaagattaaatcaaattaattttcaaaaaaaatttttttttagaaatgttattttccctgtgatagaggatgacttcccagtttcaccaaagtctgtttatatcaacacacacaaaatggaataattctgagtcactaggcaatcaatctactgtggttttactatgtaaggtgaaaattaactggaacgatgtttgtttgctatacttacatagtcaaactttacaagccatgaaattaattgcactctttgtatttgttgttaaatgcctaagaagttttctaaaaattttgtaaaggcactgtcagagaatctggagttgaatgattattccagatactgtataacctgcataactttttgtctttaagtcgtgtttgtaaaagaagtaattgctagaaacatttgataatgtacaaagtagtctataatgactgttcagtacatttttaatatttttttggttatatccaactttttgtaaatatactggaagcttgataataaaatgtatttcctatcaccatacttttccatgtgaaaacctgagcctatttctagtataagtatccaaagaaaagttttacctggttgtgttattttaccagac

SEQ ID NO: 1203 - DNA, 2002 bp, Homo sapiens
tataacgtgagggctgaatgcagcccattctctggagaacttcctcacacaccgcagcaaagagaagactgaaagacaaacctgggtgcagccagagaggtccagatagatgagcttgtggcatccattccccaagttcagcctagggactccacgtaccccagctgggtctcattgttccagaactgcattagttaagattacccagacttggatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagtttaaaaagctgaaaagcctggatctgcagcagaatgagatctctaaaattgagagtgaggcgttctttggtttaaacaaactcaccaccctcttactgcagcacaaccagatcaaagtcttgacggaggaagtgttcatttacacacctctcttgagctacctgcgtctttatgacaacccctggcactgtacttgtgagatagaaacgcttatttcaatgttgcagattcccaggaaccggaatttggcgaactacgccaagtgtgaaagtccacaagaacaaaaaaataaaaaactgcggcagataaaatctgaacagttgtgtaatgaagaagaaaaggaacaattggacccgaaaccccaagtgtcagggagacccccagtcatcaagcctgaggtggactcaactttttgccacaattatgtgtttcccatacaaacactggactgcaaaaggaaagagttgaaaaaagtgccaaacaacatccctccagatattgttaaacttgacttgtcatacaataaaatcaaccaacttcgacccaaggaatttgaagatgttcatgagctgaagaaattaaacctcagcagcaatggcattgaattcatcgatcctgggtctttgagatgaaaccctgcaagtagacttacgtgaatgatttttgctgtgccgcttttttagggctcacacatttagaagaattagatttatcaaacaacagtctgcaaaactttgactatggcgtattagaagacttgtattttttgaaactcttgtggctcagagataacccttggagatgtgactacaacattcactacctctactactggttaaagcaccactacaatgtccattttaatggcctggaatgcaaaacgcctgaagaatacaaaggatggtctgtgggaaaatatattagaagttactatgaagaatgccccaaagacaagttaccagcatatcctgagtcatttgaccaagacacagaagatgatgaatgggaaaaaaaacatagagatcacaccgcaaagaagcaaagcgtaataattactatagtaggataaggtagaaattgttctgattgtaattagttttgtattttctatactggtgttagaaaacatatgtttacatttgattaactgtgttgcctatttatgcagggtaatccagctaaaggaagctttctttaattataagtattattgtgactattatagtaatcaagagaatgctatcatcctgcttgcctgtccatttgtggaacagcatctggtgatatgcaattccacactggtaacctgcagcagttgggtcctaatgatggcattagactttcataatgtcctgtataaatgtttttactgcttttagaaaataaagaaaaaaaacttggttcatgttta

SEQ ID NO: 1204 - DNA, 2309 bp, Homo sapiens
cgatttcattcctcgctccccacaggtccctctccccaaaatattcccatcttgtcctagcccatcccccagactatctcaaggaccagctgtccccacgcccccgacctccactaggcctgtgccacccgctgcctgcaggaagacgcccggtcccgggccgggttagccccatgggaacggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttc

SEQ ID NO: 1205 - DNA, 1019 bp, Homo sapiens
ttcctttcaaatacacaccccaacccgccccggcatacacagaaatggggactgcgagcagaagcaacatcgctcgccatctgcaaaccaatctcattctattttgtgtcggtgctgtgggcgcctgtactctctctgtcacacaaccgtggtacctagaagtggactacactcatgaggccgtcaccataaagtgtaccttctccgcaaccggatgcccttctgagcaaccaacatgcctgtggtttcgctacggtgctcaccagcctgagaacctgtgcttggacgggtgcaaaagtgaggcagacaagttcacagtgagggaggccctcaaagaaaaccaagtttccctcactgtaaacagagtgacttcaaatgacagtgcaatttacatctgtggaatagcattccccagtgtgccggaagcgagagctaaacagacaggaggagggaccacactggtggtaagagaaattaagctgctcagcaaggaactgcggagcttcctgacagctcttgtatcactgctctctgtctatgtgaccggtgtgtgcgtggccttcatactcctctccaaatcaaaatccaaccctctaagaaagaaagaaataaaagaagactcacaaaagaagaagagtgctcggcgtatttttcaggaaattgctcaagaactataccataagagacatgtggaaacaaatcagcaatctgagaaagataacaacacttatgaaaacagaagagtactttccaactatgaaaggccatagaaacgttttaattttcaatgaagtcactgaaaatccaactccaggagctatggcagtgttaatgaacatatatcatcaggtcttaaaaaaaaaataaaggtaaactgaaaagacaactggctacaaagaaggatgtcagaatgtaaggaaactataactaatagtcattaccaaaatactaaaacccaacaaaatgcaactgaaaaataccttccaaatttgccaagaaaaaaaattctattyyaaact

SEQ ID NO: 1206 - DNA, 1254 bp, Homo sapiens
atggcagtggagaccacggtccacactcacctctctgcgtctccaccgcagggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaagggcgaccccgagggccccgaagcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacattgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaa

SEQ ID NO: 1207 - DNA, 800 bp, Homo sapiens
cgagcggactcgactcggcaccgctgtgcaccatggcccgggccctgtgccgcctcccgcggcgcggcctctggctgctcctggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttg

SEQ ID NO: 1208 - DNA, 3114 bp, Homo sapiens
ctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcgacccagctggcccgggcactgtatgacaacaccgctgagtccccccaggagctgtccttccgccgaggggatgtcctacgggtcctgcagagagagggcgctggtggactggacggctggtgcctctgctccctacacggccagcagggcattgtgcccgccaacagggtgaagctcttgcctgctggcccagcacccaagcccagcctctctcctgcgtccccagcccagcctggctcaccatatccagccccagatcacagcaatgaggaccaggaggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcctccctgactctgcttcttgggagcatggtgagcagccctggtgctcagcagccatacctatgggacacacactacgaaaaggatgcctttagggtttgggggagattttactcctttcttcaacaactattcactggacaagttctctgctcccatgacgcgccaggcacagttctgcaagtatattgtgaatgtattgttctagtgggatacacaaataagtcagttaaaatacataaataaaaacataaacctgc

SEQ ID NO: 1209 - DNA, 2221 bp, Homo sapiens
gctcactgccacacgcagctcagcctgggcggcacagccagatgcgagatgcgtctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcatacaacctctcctccgagtggtcggcccccagcgaccccctggacatcctgatcacaggacagatccatggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataaaagcaggtcgtctcgttccaatct

SEQ ID NO: 1210 - DNA, 1271 bp, Homo sapiens
cactgaccgtgagacccggtgggtctacatccccttttagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgcgctccccccgctaccctccgagccgcgcccctgtctcaggcacctctcggacctcgctgtgtttcactgcctcctgcccacagacccagctgccggcccggacccgtcccagcctcccctccccaccccatgcagcccccagggggatagcccatgggcccctgtggaccctccctccccaagtggacacatggctgtgcagccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggattcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtacctaaaaaaaaaa

SEQ ID NO: 1211 - DNA, 1993 bp, Homo sapiens
ccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatcccagatgaactgagggacatctgttggtctatgtataacttttaaaattggtatagtatctacagagtgtataatttaaactaaccacaaagctttacatcttcattttgactgttccatagcaaaataaagcacttgaaaggaaacaaaactccctttcacacatggattattataagtttcaatcctggtatctgtgcttgatttttatcagttttgtgtaaatttttatgtttcatattttaaatttaaatcccacattgtaaagtttgtacaatttgtcctgaagctttgtgtttggctgcacctgcataagctgctacaaataaaataaaaaatttcatagcctgtatctatcatttaaatgcatggaaaaaaatgggctttgcacacaatgggtttggagctgactgggaacaatggaaaaaattacattagctgtggttgtaaagtttttttgtttttgggttttgttttttttttgttttttttttttttttttttaccattttgtgaaaggtttttgaaaatcgataataaaaagcggttggtgtaaatttaaaaaaaaaaaaaaaaaaaaaaaaaaaaaaaaaaaaaaaaaaaaaaaaaaaaaaa

SEQ ID NO: 1212 - DNA, 1490 bp, Homo sapiens
ggggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccacaaaatggcaagtgagtagagaagatcaggacaaggttgcagttctgtcccagaacaggacagagaatgcacagaaagctggccattttgacaaagagattgtaccagttttggtgtcaactagaaaaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgttgctcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgacaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcacggtacaagacaattgcatttaacattgttataaataaaaggaacatcagatcaatcattaaaaaaaaaaaa

SEQ ID NO: 1213 - DNA, 1789 bp, Homo sapiens
agagtgaaggccaagaagcccatccagactaagttccgaatgccactcttgaactgggtggcattgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaagaaaaaaaaa

SEQ ID NO: 1214 - DNA, 4394 bp, Homo sapiens
ggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaaaaaaaaaaaaaa

SEQ ID NO: 1215 - DNA, 2917 bp, Homo sapiens
ggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctg

SEQ ID NO: 1216 - DNA, 1671 bp, Homo sapiens
cgggggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccaaaaaaa

SEQ ID NO: 1217 - DNA, 5211 bp, Homo sapiens
  Modified_base 4687: n = a,c,g, or t
cgagcgcggcgcccttgagctgcaccgcggcgcaggtttgcgagccgacttgtcagccggccaagaaaaggaagctccgtcccttcccgctcacccggcttccccaccccttgtactctaaactctgcacagggcgagcggcgcggccactgatgcgccgaggaggagcgagccgccgccgggcagcggcgtgccctcgggggagagggcgccggataagagcggcggcgcggcggcgatggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacgaaggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagctctttcagctggatcaaatgaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagargagaaaggcgctgcmctttaaatccagtatttgtttactcatgttaaaaaaaaaaaaaacagacaaaacacactgaaatttcctaactacatctatttctataatttttaaggactnttcataaggactcttaaaataatcctgaacattagaaccctaatgttcaggaagattttaatctaagcatttttatggaaatatttttaatgcagcagctattgcacttcagccaaatgtttatttcacacaaaacggatgtaacattcatgtgatcgtgcacccactggacaaaccaaaatgtgaccataactgtttaggttctgtgtgtttgtaatatgtctaataatctggagtagaaatgcgtaatttcaattactgtataaagtttatgtttttttaagtgtgcagaatctgagagcaatggtttttacttctctgtgttaattgtaatattgactctattttgtaacttaagtttctgacctgtcgtacatttgtttgagtcgtttatgtactactgaactgtaccagttgcacatgcttgaactgtagtaatgttagcttgttctaaagctatccattgtgtcatatttactctaaaaattaaagagactctcaacaaaaaaaaaaaaaaaaaaaaa

SEQ ID NO: 1218 - DNA, 1934 bp, Homo sapiens
agaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagccccaggctggagataacagcctcttgcccgtcggccctgcgtcggccctggggtaccatgtgccacaactgctgtggccccctgtccccaagacacttccccttgtctccctggttgcctctcttgccccttgtcctgaagcccagcgacacagaagggggtggggcgggtctatggggagaaagggagcgaggtcagaggagccggcatgggttggcagggtgggcgtttggggccctcatgctggcttttcaccccagaggacacaggcagcttccaaaatatatttatcttcttcacggg

SEQ ID NO: 1219 - DNA, 2392 bp, Homo sapiens
gcggagcgcgcgctcccagcgaaagcagcagggcagggatctgcgttggaggaagggactgctctggtgctagaatgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgggcgcgtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggctgattttgtgaaaatcgctcaccctgagccagcattcagagaagctgcggaagaagcttgtagaagtattggcaccatggtagagaagttgaacacaaatgtggatttatatcaaagtttgcaaaaattactagctgataaaaaacttgtggattcccttgatccagaaacaaggcgagtggctgaactgtttatgtttgattttgaaattagtggaatccatctagacaaacaaaagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccagagactgtcatgcagttccttgaaaaactatctgacaaactttctgaaagaactctgaaagattttgagatgatacgagggatgaaaatgaaactgaatgctcaaaattccgaagtaatgccctgggaccccccttactacagtggtgtgattcgtgcagaaaggtataatattgagcccagcctatattgcccgtttttctctcttggagcatgcatggaaggcctgaatattttgcttaacagactgttggggatttcattatatgcagagcagcctgcaaaaggagaggtgtggagcgaagatgtccgaaaactggctgttgttcatgaatctgaaggattgttggggtacatttactgtgatttttttcagcgagcagacaaaccacatcaggattgccatttcactatccgtggaggcagactaaaggaagatggagactatcaactcccacttgtagttcttatgctgaatcttccccgttcctcaaggagttctccaactttgctaactcctggcatgatggaaaatcttttccatgaaatgggacatgccatgcattcaatgctaggacgtactcgttaccaacacgtcactgggaccaggtgccctactgattttgctgaggttccttctattctgatggagtactttgcaaatgattatcgagtagttaaccaatttgccagacattatcagactggacagccactgccaaaaaatatggtgtctcgtctttgtgaatctaaaaaggtttgtgctgcagctgatatgcaacttcaggtcttttatgccactctggatcaaatctaccatgggaagcatcccctgaggaattcaaccacagacattctcaaggaaacacaagagaaattctatggcctaccatatgttccaaatactgcctggcagctgcgattcagccacctcgtggggtatggtgctagatattactcttacctcatgtccagagcggtcgcctccatggtttggaaggagtgttttctacaggatcctttcaacagggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataaaagaaacactctacacctctaatcaaggtcatgtagtaatgactttgttataaatgctacagctgtgagagcttgtttctgattgtttcattgttcgcttctgtaattctgaaaaactttaaactggtagaacttggaataaataatttgttttaattaaaaaaaaaaaaaaaaaa

SEQ ID NO: 1220 - DNA, 9390 bp, Homo sapiens
ggcaatttcttttcctttctaactgtggcccgcgttgtgctgttgctgggcaggcgttgggcgccggcggtcttcgagcgtgggggcccgctggctttcccttctcagaaactgcgccgggggcgctcgcttgccccggattcggacgcggcgctccccgggctcgtctgaagtgcagatcgccgcagaggccccagtgcccggatgtccatcaggattagcgcgagccaatacgggccgagcccggggctgcgccgaggacgcccggggctcgagagcaggtagtcccgtaacatcggggcgccgcgccgggacgcgtccccgcccggctccgccaaatggtgagcgcggcgctggcagcagggcccgcggggtgaaggcgctcatggacggaagacccctggctctataagctgaattatggcagcccagtcaagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggagcctgagcctccaacaacaaacaaatggcagctggacaactggctgaccaaagtcagccagccagctgcgccaccagagggccccaggagcacagagcccccacggcggcacccagagagtaagggcagcagcgacagtgccacgagtcaggagcattctgaatccaaagatcctccccctaaaagctccagcaaagccccccgggccccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcagggggaaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcggcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctcccaaaagtgccagcagtaccaagagcaaccacaaagactcttccattcccaagcagagaagagtagaggggaagggctccagaagctcctcggagcacaagggttcttccggagatactgcaaatccttttccagtgccttctttgccaaatggtaactctaaaccagggaagcctcaagtgaagtttgacaaacaacaagcagaccttcacatgagggaggcaaaaaagatgaagcagaaagcagagttaatgacggacagggttggaaaggcttttaagtacctggaagccgtcttgtccttcattgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccgcctttgacctttgggaacaggccgaggccctcacgaggaagaataaagaattctttgctcggctcagcacaaatgtgtgcaccttggccctcaacagcagtttggtggacctggtgcactatacacgacagggttttcagcagctacaagaattaaccaaaacaccttaatggagccccaggttgattcaatgccttgggaactatttttgcacattggaagcctcaaaaacagtccagacgtttgtttcatcaggacaccaaactctaaaaaagaagcaccacgagatggccaggacatttgtccacttaaactctcaacaacagtgtgatcattggttggacactgtggttatgcagaagcagagatgaggaggctggccccagagatgatcttgcccttcctaactaaaggacagaagtgcaatttagcttaaatgggtgtatgaatggtctagaaacatttctattttttttttaaaccagcaggatacaagttgcaaatgaaatgaggagaaacagtttcaactctgaaagtgaatttcacgtcatctcagtagccacgctagtccattcccagaaggaaatttttttttttaacaatgacttttggtaaagggttttgtggatgattttttttcttttgagttttgggagaaatatttgtttaataacttctaatggccatctgtaaaccataagtaatgaaggactccactgtgccccactttctgccaatgaacagtggcttgataataccaagtattgttgtaatttataaaattgaaggcaacccccgctcctgccgcccccaatctccccattgcctagagcgctgcacattgaccccagctctgacttctcattactgtgctgaaagtcagcccacgtcggagcggtgaggaggagccacagcacatggggtgccacctcgaggtctgcacaggaggacttggcgctgccatttcctacccctgccatttcccacccctgcttcagcgaaagggactctctaacagggcagtcactgttgactctattctgaatttcctcccttggggaagaagggaaccaacatttatacctgaccagatggctaaagtgcttttaaagttttgtttaagtagagctggaatttgaggtgctgatctgtggtctacagttatgtggtaactcatgttgtccagccaactcagagtttcgtcagtgaacaagaaacatgaaatctgcttcttagagaggctatatttttctgctacaaatattttatatttatagcaaaactagactttcagagtccttgattgtctaggggaagttaactccctgagaggatgtagagatttggggtggttgattagacttttgaaaaactcatcaccacatgccttcactccagagtgttctcagctagatttgatttggttgaggaggaactgtggccctccgtaagttattgccatagtgtatgcattaaaccaagtccattttgaatgacctaaaatgaagtaacacaatcagaaatcccatgtgcccataagcacagatttttctttttcattgaaactttaaaggttattattggaaacattactttgagtgcagtgtttttaaaagccaattcttttttatcccttttagaagtagaatttgcacacttactacaattgaggagtgtcatctctataactttttctccgcctttgtcccattctgcccctggacatgtttcctaccaagcatgtttcacattttcctattagtggaggagggagaaccatatttatttataatgaagacatctaagatccctatgatgaatgcaggaactctcttggtagtttgtaaatacacaaagggatgtgtcgagggatgggagcgatgcttatctctcacagtgtgagtggtctgtgtgaggctgttccttcagttcttctccagactgttctttggttgtcacttaagtcagaggtctggtccctcatgtttaggtgaaagccagagaatgacagctgtagtcatatctgagcataagaccttgatgtgtgattcctgatgaccggtttcatttattcatgtaataaagcaaaggccctggtcctttttaaactactagttttaaaaacctgtgttaaatgaacagtaattgcctggtaggtttggtgtgtgtgtagcattgtgtgtccatctgttatatgtaaaggacaaggcaccagaatcaggctttatttcgatattgaagatgttatttaacatctttcttttttccttactcccttagccatcccctccccttttgtcctatcattccctagaacaagccacctgtcaattgtgaagggttgtgttctttatggcaggttctatgcagattgtgccagagcatgtgcgtgttctgttggcaagccacagtgctcccttgactgaagacatttccaggtagatttctcagccagctctaaaacagattgctttttcagtggccttactctttgtgggtttttttttttctctgaacttgatataaagattttatttgtcccttgaaaaagtaacaaatgtgcatagatcaatttgtactactttggtcattggatatttctgatccttattgcattgtacctaaaggagagtaactaatggtaacctttttaatagagtatgtgaaaggtagtggctgatgaatccttaacgttcatagggtctttttgctgttacggttgtatatagaggtctgaaggatttttaaaatgatttgcactttttcactgcatgcttacaattcccaaaggcaaaatctgtactgaggtagatcatttgaaagggctagattataaaattaagccttagagtatggaaagttcttataacaataatagtacacacttcagagtaagacaaatgcaaagcatcttaaggagtgaaaatagagtctaaatcttgcctttggcactacaaggtgtgtgtgtgtgtgtgtgttgtgtgtctttagtaggaaatggaagaacactgttttattttttaaagtgtttaatgtttctgtcctttctgtgaattattgaatttaagagccctgctaaataatgaaaaaacactttactaaaatttatcaaattatactgggttcggattgtgaaaacattggccacctagtagcagtggtgaggagtgggagggcccagcaagcatttatcagaaatagaatcacaataggaggagaatttggctgtctgatattatgatttgattacaatactgaatgggaaaagtatctaatattttgtaacaaaaagaccttcatattatctgttttgaccaaaatatgtagctatttcccttacacagattggaccgcacttatctcccttgtcctgtatcctttaatttcaggtctcaggatgtttagaaagctaaaaccccctacccctttctggctgaaaacttgccttatttggtatcttacacattaatgttactagcatcaggagcttactgttttattatgattcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgaaaagtgagagttacgcattgcagccatgaagggatgctaggatcaattatggcagtaccttttttcccctcctgttcttgagccagttgtctcttttgttttgggtcccacttaggattaacggatgtaaggtattttcctgtgcctttattttgtgtcattctattggaaggaggtgtaacggcagaatagcatcgtgttgggggttttccttcaaacactgcaagtgatattgccaccatgtgaacctcaaatatgcaatccagttgtgttggtttctcggtgacttggagtgttcatctcttcatgaattgtgagcactgaccatgttcttcagttcttaattatggtgagttgacaaataccaactactgcttttctttaggtggctataaatttcttactgtcaggaggaaatgacattatattctgttccactgaacgtcagagatcagcaggcactgtactgggtagagaagtgcctatacttctctacctaagagggcaggagggaaaccctacagctccttgtgagcctatatattagtatatcggcctggagaggacaagggaataagaccactcatagtgaggctggccaagctgcactggtcggaccaggcagtggctgacctaaggaaggcaacttgctttgcttaaaagtagattttttaagcaatgcttaacacaggcagcattcacctttgttcaggccatcgacatgtattgttaaaattactgcatatccccctcagatatcaagtatacactgttcatgttggggttgtgtgtgtgtatgtgtgtatgtacgcacgcatgtgtcccaaatcttgttttaattttttttttctgaatgtgatcatgttttggataatacctgagcagggttgccttttttttatttattaccattatatattatattatattatatattttttgctttcttataactttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgtgaataaaatttagctgccttgtatagtcgtttgaaagaatatgtgatctgtgagagaattatagtttttttttagaagaaaaatctgcaaaagatctttccaaagacaatgtgccacagatcttttgttctctgtaatgaggattaattgctgtttaaacaaaaatgtaattgttcatctttaaattctttccttttcataagaggatcaagctgtaaaaaaacaaaaaaattaataaaaatttcgagaaatcaaaaaaaaaaa

SEQ ID NO: 1221 - DNA, 1416 bp, Homo sapiens; identical to SEQ ID NO: 405
  Modified_base 1311: n = a,c,g, or t

SEQ ID NO: 1222 - DNA, 186 bp, Homo sapiens
atggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctga

SEQ ID NO: 1223 - DNA, 428 bp, Homo sapiens
ctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttga

SEQ ID NO: 1224 - DNA, 4221 bp, Homo sapiens
cagcccgagcccgagcccgagcccgagccggcgccaccgcgcccccggccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggccaagaataaggagacgggtgctttggctgcggccaaagtcattgaaaccaagagtgaggaggagctggaggactacatcgtggagattgagatcctggccacctgcgaccacccctacattgtgaagctcctgggagcctactatcacgacgggaagctgtggatcatgattgagttctgtccagggggagccgtggacgccatcatgctggagctggacagaggcctcacggagccccagatacaggtggtttgccgccagatgctagaagccctcaacttcctgcacagcaagaggatcatccaccgagatctgaaagctggcaacgtgctgatgaccctcgagggagacatcaggctggctgactttggtgtgtctgccaagaatctgaagactctacagaaacgagattccttcatcggcacgccttactggatggcccccgaggtggtcatgtgtgagaccatgaaagacacgccctacgactacaaagccgacatctggtccctgggcatcacgctgattgagatggcccagatcgagccgccacaccacgagctcaaccccatgcgggtcctgctaaagatcgccaagtcagaccctcccacgctgctcacgccctccaagtggtctgtagagttccgtgacttcctgaagatagccctggataagaacccagaaacccgacccagtgccgcgcagctgctggagcatcccttcgtcagcagcatcaccagtaacaaggctctgcgggagctggtggctgaggccaaggccgaggtgatggaagagatcgaagacggccgggatgagggggaagaggaggacgccgtggatgccgcctccaccctggagaaccatactcagaactcctctgaggtgagtccgccaagcctcaatgctgacaagcctctcgaggagtcaccttccaccccgctggcacccagccagtctcaggacagtgtgaatgagccctgcagccagccctctggggacagatccctccaaaccaccagtcccccagtcgtggcccctggaaatgagaacggcctggcagtgcctgtgcccctgcggaagtcccgacccgtgtcaatggatgccagaattcaggtagcccaggagaagcaagttgctgagcagggtggggacctcagcccagcagccaacagatctcaaaaggccagccagagccggcccaacagcagcgccctggagaccttgggtggggagaagctggccaatggcagcctggagccacctgcccaggcagctccagggccttccaagagggactcggactgcagcagcctctgcacctctgagagcatggactatggtaccaatctctccactgacctgtcgctgaacaaagagatgggctctctgtccatcaaggacccgaaactgtacaaaaaaaccctcaagcggacacgcaaatttgtggtggatggtgtggaggtgagcatcaccacctccaagatcatcagcgaagatgagaagaaggatgaggagatgagatttctcaggcgccaggaactccgagagcttcggctgctccagaaagaagagcatcggaaccagacccagctgagtaacaagcatgagctgcagctggagcaaatgcataaacgttttgaacaggaaatcaacgccaagaagaagttctttgacacggaattagagaacctggagcgtcagcaaaagcagcaagtggagaagatggagcaagaccatgccgtgcgccgccgggaggaggccaggcggatccgcctggagcaggatcgggactacaccaggttccaagagcagctcaaactgatgaagaaagaggtgaagaacgaggtggagaagctcccccgacagcagcggaaggaaagcatgaagcagaagatggaggagcacacgcagaaaaagcagcttcttgaccgggactttgtagccaagcagaaggaggacctggagctggccatgaagaggctcaccaccgacaacaggcgggagatctgtgacaaggagcgcgagtgcctcatgaagaagcaggagctccttcgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttgtcacctgaacctaatgtatattctccttgagccccagatcccttcaagctggaagggatggggctgttggtggggtcagggtccaagaggaatgggtgttctgtggcctcgagtcctctcctgtttgcgaaaataccagttttgctctctgtgggacaaagcactgctgatgaagtccccgtgggctcatccgggctggaattcttggtttttcagccattccctgcagagtcactcaatcatcaagtccctcacagccatttctgttcccagaggagccaggcctgcagctggctgctcaggagatggcctcattcctcctgttctcccagtttgctttccacttaagacaaagccttgtctatgtggggggcggggaccggggaaagagggaggctgaaatgtttattctgcttctcccgtgtttcatgccatctcgcgtcccccttcctgcacatgggtgtgaatgcacacacatacgcgtacacacaggacttggtctgctggcctggcctcttctgcccaggtgggttggaacacgtttgctgcctgagcctgtgccactgagcatgttaggtggagcagttggtgtggcacgtgcggggtgttggcaccggaggcatggaaaagcacaggctgtactgccaggctgcgatgcgtgctggcccccgcacaggctcctgtgtgcagggactgattcctcagcacacgaggcttccacaacccagtctgctccatagcactctggcccaccctgtctgcaggtgaaacaggagggctgtttgcctctgccccatccccccgactgtgttcaggagtcccaccttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagctgcagaatgtatataacacaataaaagcaaatgtttgaaccagt

SEQ ID NO: 1225 - DNA, 802 bp, Homo sapiens
ggagggccgggcaccgcggcatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgcccatacactaactcaaaaattttgatattttcc

SEQ ID NO: 1226 - DNA, 515 bp, Homo sapiens
ggggggctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgattcctctcgatcacatacagaagaggattgcacggaggagctctttgacttcttgcatgcgagggaccattgcgtggcccacaaactctttaacaacttgaaataaatgtgtggacttaagttgcaccccagtcttcatcatctgggcatcagaatatttccttatggttttggatgtaccatttgtttcttatttgtgtaactgtaagttcacatcaacctcatgggtttggcttgaggctggtagcttctatgtaattcgcaatgattccatctaaataaaagttctatgatctgcaaaaaaaaaaa

SEQ ID NO: 1227 - DNA, 3640 bp, Homo sapiens
gtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcggatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcatcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggttaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaatgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaagagcgtgctgctcagcctgcgccagggcagcctcatcgagttcagcaccatcctggagggccgcctgggcagcaagtggcctgtcttcgagctcaaggccatcagctgcctcaactgcatggcccagctctcacccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctgtccagcaggtagtgggtgaatgtgtgaaggtcttgcctgaatccatcaggacttgggaaacagagaaccctgtgggggcggctgtgggggaggtccctgccagtgtttagaagagcctgactgtgttcagtgccttggagcagaaagccagggtcctgagtggctgaaataaaagcctctggtggaacctgca

SEQ ID NO: 1228 - DNA, 2197 bp, Homo sapiens
caggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtgacaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaaaaaaaggaattc

SEQ ID NO: 1229 - DNA, 3794 bp, Homo sapiens
ccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagccatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatggaattccagatgtaggcattccccccaggtcttttcatgtgcagattgcagttctgattcatttgaataaaaaggaacttgg

SEQ ID NO: 1230 - DNA, 2051 bp, Homo sapiens
cgccactttgctggagcattcactaggcgaggcgctccatcggactcactagccgcactcatgaatcggcaccatctgcaggatcactttctggaaatagacaagaagaactgctgtgtgttccgagatgacttcattgccaaggtgttgccgccggtgttggggctggagtttatctttgggcttctgggcaatggccttgccctgtggattttctgtttccacctcaagtcctggaaatccagccggattttcctgttcaacctggcagtagctgactttctactgatcatctgcctgccgttcgtgatggactactatgtgcggcgttcagactggaactttggggacatcccttgccggctggtgctcttcatgtttgccatgaaccgccagggcagcatcatcttcctcacggtggtggcggtagacaggtatttccgggtggtccatccccaccacgccctgaacaagatctccaattggacagcagccatcatctcttgccttctgtggggcatcactgttggcctaacagtccacctcctgaagaagaagttgctgatccagaatggccctgcaaatgtgtgcatcagcttcagcatctgccataccttccggtggcacgaagctatgttcctcctggagttcctcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctcaaataaccattccaagaagggacattgtcaccaagaaccagcatctctggagaaacagttgggctgttgcatcgagtaatgtcactggactcggcctaaggtttcctggaacttccagattcagagaatctgatttagggaaactgtggcagatgagtgggagactggttgcaaggtgtgaccacaggaatcctggaggaacagagagtaaagcttctaggcatctgaaacttgcttcatctctgacgctcgcaggactgaagatgggcaaattgtaggcgtttctgctgagcagagttggagccagagatctacttgtgacttgttggccttcttcccacatctgcctcagactggggggggctcagctcctcgggtgatatctagcctgcttgtgagctctagcagggataaggagagctgagattggagggaattgtgttgctcctggaggaagcccaggcatcattaaacaagccagtaggtcacctggcttccgtggaccaattcatctttcagacaagctttagagaaatggactcagggaagagactcacatgctttggttagtatctgtgtttccggtgggtgtaataggggattagccccagaagggactgagctaaacagtgttattatgggaaaggaaatggcattgctgctttcaaccagcgactaatgcaatccattcctctcttgtttatagtaatctaagggttgagcagttaaaacggcttcaggatagaaagctgtttcccacctgtttcgttttaccattaaaagggaaacgtgcctctgccccacgggtagagggggtgcacgttcctcctggttccttcgcttgtgtttctgtacttaccaaaaatctaccacttcaataaattttgataggagacaaaaaaaaaa

SEQ ID NO: 1231 - DNA, 1542 bp, Homo sapiens
tgcgtttagggcgaagacggagttgtaaacttcttaaaattcctctctcgacacttcggtaattcctctttcgagactaaagctctttttgtatgcgtgtgtgtcaagcgtatgccccgggattctcctccgcttccttttctcggtcttccttcttgctttagggaccggaagagtccttgaaccaaaatagctcggcgggcacttccggggccggcgcccagagttccgggagggtgcaggcaggagagggaaaggcagcagcggcggcagctggaggatgaagaaggagcatgtgcttcactgccagttctccgcgtggtacccgttcttccgaggcgttaccatcaagagtgtcattcttccacttcctcagaatgtgaaggattatttactcgatgatggaactctggtggtttcaggaagggatgatccaccaacacattctcagccagacagtgatgatgaagcagaagaaatacagtggtctgatgatgagaacacagccacgcttacggcaccagaatttcctgagtttgccactaaagtccaggaacctatcaattccctcgggggcagtgtctttcctaagcttaattggagtgccccaagggatgcgtattggatagcaatgaatagttctctgaaatgtaaaaccctcagcgacatctttctgcttttcaagagttccgatttcatcactcgtgacttcactcagccgtttattcattgtactgatgattctccagatccatgtatagaatatgagctcgttctccgaaaatggtgtgaattgattcctggggctgagtttcgatgttttgtcaaggaaaacaagcttattggtatttctcaaagagactacacacaatactatgatcatatttctaaacaaaaggaagaaattcgcagatgcatacaagactttttcaagaaacacatacagtacaaattcttagatgaagactttgtgttcgatatatacagagacagtagggggaaggtgtggctcattgactttaatccatttggtgaagtcacagattcactgctgttcacctgggaagaactgatatctgagaacaacttaaacggcgattttagtgaagttgacgctcaagagcaggattccccagctttccgttgcacaaacagtgaagtgacagtccagcccagcccctatttgagttaccggctacccaaggactttgtagacctctctactgggagggacgctcacaagctaatagacttccttaagctgaagagaaatcagcaggaggacgactgatgagcgtactgtaactggagaagaggaggccccgccccaccgctccgggagctgctcatcagccgcaacttcctgccgaccctgatgcgggtgggccgagcagtgtggacatcagccactttttatattcatgtacattcacctggggaaaaaaacggagggactttgctacttgtaaaaataacataataaatagatcttaaacataggaaaaccatactgttctgataataaaatgctttctatgaaat

SEQ ID NO: 1232 - DNA, 2912 bp, Homo sapiens
tgcacatgcgatctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacttctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacatttgtatattaactttaaaaaaaaaaaaaaaaaa

SEQ ID NO: 1233 - DNA, 2136 bp, Homo sapiens
  Modified_base 329, 1228, 1697, 1837: n = a,c,g, or t
cgaggagcgacggccggacccagacccagacgcaagatggcgacggccgcgtgactgcctcagcgtccccgagctcggctccgagtgcacctacggactgactgtgggggcagagaagggcgagatcaggactctgtctttgttaatcgtgactgcatgaaggtcgcctccctcgggcctacttggtgggagtgtctggtattgttctaaggccaggagcacggtgagccacagtctgttggtagaatttggcgtcttgatagttgagaaaatggcgatgacactgttggaagactggtgccgggggatggatgtgaactcccagaganctctgttagtctggggcatcccagtgaactgtgatgaggctgaaatcgaagagaccctccaggctgcgatgccccaggtctcctaccgaatgcttgggagaatgttctggagggaagaaaatgcgaaagcagccttattagagctcactggcgctgtagattacgccgcgatccccagggagatgccgggcaaaggaggggtctggaaagtgttatttaagcccccaacttctgatgctgaatttttagaaagattgcacctcttcctagctagagaggggtggaccgtgcaagatgttgcccgtgtccttgggtttcagaaccctactccgaccccgggcccagagatgccagcagagatgctaaactatattttggataatgttattcagcctcttgttgagtccatatggtacaagaggctgacacttttctcggggacgggacatcccagggcctggagaggaaactttgatccctggctggagcacactaatgaggtcctagaggagtggcaggtgtccgatgtagaaaagaggcggcggttgatggagagtcttagaggccccgccgctgatgttattcgcatccttaagtccaacaaccccgcgataaccactgccgaatgcctgaaggcgcttgagcaggtgtttgggagcgttgagagctctagggatgcccagatcaaatttctgaacacttatcagaacccgggagaaaaattgtctgcttatgtcattcgtctggagcctctgctacagaaggtggtagagaagggggccattgataaagataatgtgaaccaggcccgcctagagcaggtcattgccggggccaaccacagcggggccatccgaaggcagctgtggcttaccggggctggggaagggccagccccnaacctctttcagttgctggtgcagatccgtgaggaggaagccaargaggaggaggaggaggctgaggccacccttctgcagttaggcctggaagggcacttctgagtgccaggaaaggcagctttagtgcagacctagatcacagctacttttcttgtccctgtggggtcttacagatgtgtctctgagtagtaaaggcttagccttgttctgttttgttgttttttggaggggaaggttagtcaggcctgagtattcatgtaacattctaaaattgtgccagcgagcaccgtgaacgactgcaatgcaagcgggtcttgctggctaaaatgcccaggtaaagggttggttggacacagcgcttagtgcacgctgtcatcatggacatcataatcagttgtgaaaaacacgcgaacctatgacacttcttattccacactgaatgtgaaattgcatgttcagatgtttnactacgaggcctggctcacaggaagtgttcagtaaaagtatgcactgttagattactgataacgcggatagatttttgttwaccataaattgttccagatttatattaatggaaggaagtgtgcatttattagctattantcaactttacaakgcaaacatcttatttctcatctttaaacatgtcgaccagtttaattgaaaagtattctgagactgcaaaatggggtgttaaaaaatactgcagttacggagctgtgtaaaccagtttctcattgcataagatacagatgtaaattgcatggagaggttgatatgcacctgtacagtaattcactcccccatttcacttctttgtcagagaatagttcttgttcatactgagtgttctaaatttgaagttatatatacaaattaaaatattttaaaaaaaaaaaaaa

SEQ ID NO: 1234 - DNA, 3927 bp, Homo sapiens
agcagcgagtccttgcctcccggcggctcaggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacaggtttggatcctgccgggcccatgtttgaaggggccgacatccacaagaggctctctccggacgatgcagattttgtggatgtcctccacacctacacgcgttccttcggcttgagcattggtattcagatgcctgtgggccacattgacatctaccccaatgggggtgacttccagccaggctgtggactcaacgatgtcttgggatcaattgcatatggaacaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagagtttaccattatcagatgaaaatccatgtcttcagttacaagaacatgggagaaattgagcccaccttttacgtcaccctttatggcactaatgcagattcccagactctgccactggaaatagtggagcggatcgagcagaatgccaccaacaccttcctggtctacaccgaggaggacttgggagacctcttgaagatccagctcacctgggagggggcctctcagtcttggtacaacctgtggaaggagtttcgcagctacctgtctcaaccccgcaaccccggacgggagctgaatatcaggcgcatccgggtgaagtctggggaaacccagcggaaactgacattttgtacagaagaccctgagaacaccagcatatccccaggccgggagctctggtttcgcaagtgtcgggatggctggaggatgaaaaacgaaaccagtcccactgtggagcttccctgagggtgcccgggcaagtcttgccagcaaggcagcaagacttcctgctatccaagcccatggaggaaagttactgctgaggacccacccaatggaaggattcttctcagccttgaccctggagcactgggaacaactggtctcctgtgatggctgggactcctcgcgggaggggactgcgctgctatagctcttgctgcctctcttgaatagctctaactccaaacctctgtccacacctccagagcaccaagtccagatttgtgtgtaagcagctgggtgcctggggcctctcgtgcacactggattggtttctcagttgctgggcgagcctgtactctgcctgacgaggaacgctggctccgaagaggccctgtgtagaaggctgtcagctgctcagcctgctttgagcctcagtgagaagtccttccgacaggagctgactcatgtcaggatggcaggcctggtatcttgctcgggccctagctgttggggttctcatgggttgcactgaccatactgcttacgtcttagccattccgtcctgctccccagctcactctctgaagcacacatcattggctttcctatttttctgttcattttttaattgagcaaatgtctattgaacacttaaaattaattagaatgtggtaatggacatattactgagcctctccatttggaacccagtggagttgggatttctagaccctctttctgtttggatggtgtatgtgtatatgcatggggaaaggcacctggggcctgggggaggctataggatataagcattagggaccctgaggctttaagtggtttctatttcttcttagttattatgtgccaccttcttagttattatgtgccacctcccctatgagtgacgtgtttgatcactagcagaatagcaagcagagtatcattcatgctggggccagaatgatggccggttgccagatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagtagggggagaagggcaactattattatccctattttacaaaactgaggcttagtgaggttcagccacatgcctagacttatatactagttagtggtgcagccagggagaggactcagatttcctggaggcaaagtctatctctgaaactccatgaagacttttgcagccagttcccaccaatatgccccagacgtgagacaaacaaggacttttttttttatatagagccatccataaaatcctaagcccttttattaatgtataaccaggagaacatctgtgccaacggttggactttttatggctgagattcgggaggaagtgtgacaccaagcaggagaggaagaatgattttctttgtacttaggttttctaaggacattgttttaatctgtatcgtgccaaagttgtatcactgttaaacttctgaagacataaccagttgagtcttatttcaagatatgttctcaagccaattgtgtgcttctcttgtttctgtgattgctttctagccaaagcgaagcttgtacaggttgagtatcccttatccaaaatgcttggaaccagaagtgtttcaaattttagattattttcagattttggaatgtttgcatatacataatgagatattttgggaataggacccgagcctaaacacaaaattcattgatgtgtcagttacaccttatccacatagcctgagggtaattttatacgatattttaaatagttgtgtacatgaagcatggtttgtggtaacttatgtgaggggttttcccattttttgtcttgttggtgctcaaaaagttttggattttggagcatttcggattttggatttttggattagggttgctcaacccatattattggctgtacatcctggtcacttctgacttctgtttttactaatggaagctttgca

SEQ ID NO: 1235 - DNA, 1828 bp, Homo sapiens
gctgggctgagagtgcgggccggcagaggctggcggggagcagccggggttatgctgggcaaggattacatgctggccatcattctggtcaactgcgatgatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgagggccagaacatgctgatgatcctgaagaaggatgccatgagcctagtgaatcccctggaccacagtctgatccactgccagcctctggtgcacatccgtgtgtggggcgtggggagctccaagggccgtgacagggacttcgcttttgtggcaagtgacaaagatagctgtatgctcaagtgccatgtgtttcgctgtgatgtccctgccaaggccattgccagtgccctacatgggctttgtgcccagatcttgtcagagcgagtagaggtcagtggtgatgcctcttgctgctccccagaccccatctctcctgaagacctgccacggcaagtggagctgctggatgcggtaagccaagctgctcagaagtacgaggcactgtatatggggacactgccagtcaccaaggccatgggcatggatgtgctgaacgaggccattggtaccctcaccgccaggggggaccggaatgcctgggtccccaccatgctcagtgtgtctgactctctcatgactgcacatcccattcaggcagaggccagtacagaggaggagccattgtggcagtgccctgtgcgccttgtgacatttattggtgttggccgcgacccacacacctttggcctcatcgctgacctgggccgtcagagcttccagtgcgcagccttctggtgccagccccatgcagggggactctctgaagctgtgcaggctgcctgtatggttcagtaccagaagtgtcttgtggcctctgcagctcgaggcaaggcctggggtgcccaggcccgtgcccgcctgcggctcaagcggaccagctccatggattccccaggaggtcccctgcccctccccctgctcaaaggaggggttggcggtgcaggggcaacccctcgaaagcggggtgtcttctcttttcttgatgccttccggctgaaaccctctctgctccatatgccctaaacttatctgggaaggctggggaagtaggctctgggtccatgcctaactctgtaccgttttattcctcaaggcctatagcctgtcactccttgaagccttctctgcctgtccctccgatccttgtccaccgtctatttattgcccaatttattgtttatacggatgactgggaggcactgcaccacaacgtaggaccctggctcccctttccttgggtccttgtgttccttgcccctgtccaaccctggacagttggctctacctcagtaacactttatagcaaaatcagtgcaaataaaaatccctcagtgacctc

SEQ ID NO: 1236 - DNA, 4544 bp, Homo sapiens
ccgagaagggcttcaggacgcgggaggcgcacttgcttcaagtcgcgggcgtgggaacggggttgcaaaacggggcctttttatccgggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaaaggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcagcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactataaaaaaa

SEQ ID NO: 1237 - DNA, 2811 bp, Homo sapiens
gaattcggcacgagctcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccatggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggaggatcaagaggctgagaagctggaagatgacatcagacaagagagaaccgcctggaagatcgagagacagaagattctgaaagggttcaatgaaatgagagtcatcttggacaatgaggagcagagagagctgcaaaagctggaggaaggtgaggtgaatgtgctggacaacctggcagcagctacagaccagctggtccagcagaggcaggatgccagcacgctcatctcagatctccagcggaggttgacgggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgctccctgtcgtattggggttttcctagactatgaggcaggcattgtctcatttttcaatgtcacaaaccacggacgactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttctgtgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctgaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggcctcagggcccaccgctaatgccttaatgaaatcattttaacattatattgtgtacaaagaccttatttccaaataagataatatttggaggtattgggaataaaatttgaggaaggcgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtcataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactgaaaagatgtcagccatttcaatgtcttgggaaacaattttttgtttttgttctgttttctttttgcttcaataaaacaatagctggctctaaaaaaaaaa

SEQ ID NO: 1238 - DNA, 1648 bp, Homo sapiens
atgcgggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggggggacgggctccggcatgggcacgttgctcatcagcaaggtgcgtgaggagtatcccgaccgcatcatgaacaccttcagcgtcgtgccctcacccaaggtgtcagacacggtggtggaaccctacaacgccacgctgtccatccaccagctggtggaaaacacggatgaaacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcaccaggcggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaaactgctcgcagctggagtgagaggcaggtggcggccggggccgaagccagcagtgtctaaacccccggagccatcttgctgccgacaccctgctttccccatcgccctagggctcccttgccgccctcctgcagtatttatggcctcgtcctcccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 1239 - DNA, 1335 bp, Homo sapiens
atgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtgggacggggtccggaatgggcacgctgctcatcagtaagatgcgcgaggagttcccagaccgcatcatgaacaccttcagcgtggtgccctcgcccaaagtgtcagacacggtggtggagccctacaatgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggtcccctttcctcgcctgcacttcttcatgcccgcgttcgcacccctgaccagccggggcagccagcagtaccggggcctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgtgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgagcagggcgagttcgaggaggaggcggaggaggaggtggcctag

SEQ ID NO: 1240 - DNA, 3020 bp, Homo sapiens
tgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacaccctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagctttccggaaacaaaatccttttcttcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcaacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggtccaggaattttgagagattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatggactttccttccctctcctgcttcctcttttcctgctccctaacctttcgccgaatggggcagacaaacactgacgtttctgggtggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtgggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcaaaaaaaaaaaaaaaaaaaa

SEQ ID NO: 1241 - DNA, 2150 bp, Homo sapiens
ctcgagccacgaaggccccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaaaaaaaaaaaaaaaaaaaaaaaaaaaaaaaaaaaaaaaaaaaaaaaaaaaaaaaaaaaaaaa

SEQ ID NO: 1242 - DNA, 583 bp, Homo sapiens
cccctgcaccccgcccggcatagcaccatgcctgcttgtcgcctaggcccgctagccgccgccctcctcctcagcctgctgctgttcggcttcaccctagtctcaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgccttctctgccccaatgataaggagggttcctgcccccaggtgaacattaactttccccagctcggcctctgtcgggaccagtgccaggtggacacgcagtgtcctggccagatgaaatgctgccgcaatggctgtgggaaggtgtcctgtgtcactcccaatttctgaggtccagccaccaccaggctgagcagtgaggagagaaagtttctgcctggccctgcatctggttccagcccacctgccctcccctttttcgggactctgtattccctcttggggtgaccacagcttctccctttcccaaccaataaagtaaccactttcagcaaaaaaaaaaaaaaaa

SEQ ID NO: 1243 - DNA, 1584 bp, Homo sapiens
gcgtcccccacaccacagacccgcgccgccgacgacccagcagccgccatgcgtctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttactgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttc

SEQ ID NO: 1244 - DNA, 4772 bp, Homo sapiens
atccttgccgcccgccccggcccagccgcgtcccggagccgtcgggcatggagccgtggaagcagtgcgcgcagtggctcatccattgcaaggtgctgcccaccaaccaccgggtgacctgggactcggctcaggtgttcgaccttgcgcagaccctccgcgatggagtcctgctctgccagctgcttaacaacctccgggcgcactccatcaacctgaaggagatcaacctgaggccgcagatgtcccagtttctctgtttgaagaacataaggacatttctcacggcctgttgtgagacgtttggaatgaggaaaagtgaacttttcgaggcatttgacttgtttgatgttcgtgactttggagaggttatagaaacattatcacgactttctcgaacacctatagcattggccacaggaatcaggcccttcccaacagaagaaagcattaatgatgaagacatctacaaaggccttcctgatttaatagatgaaacccttgtggaagatgaagaagatctctatgactgtgtttatggggaagatgaaggtggagaagtctatgaggacttaatgaaggcagaggaagcacatcagcccaaatgtccagaaaatgatatacgaagttgttgtctagcagaaattaagcagacagaagaaaaatatacagaaactttggagtcaatagaaaaatatttcatggcaccactaaaaagatttctgacagcagcagaatttgattcagtattcatcaacattcctgaacttgtaaaacttcatcggaacctaatgcaagagattcatgattccattgtaaataaaaatgaccagaacttgtaccaagtttttattaactacaaggaaagattggttatttacgggcagtactgcagtggagtggagtcagccatctctagtttagactacatttctaagtcaaaagaagatgtcaaactgaaattagaggaatgttccaaaagagcaaataatgggaaatttactcttcgagacttgcttgtggttcctatgcaacgtgttttaaagtaccaccttctcctccaggaactggtcaaacataccactgatccgactgagaaggcaaatctgaaactggctcttgatgccatgaaggacttggcacaatatgtgaatgaagtgaaaagagataatgagacccttcgtgaaattaaacagtttcagctatctatagagaatttgaaccaaccagttttgctttttggacgacctcagggagatggtgaaattcgaataaccactctagacaagcataccaaacaagaaaggcatatcttcttatttgatttggcagtgatcgtatgtaagagaaaaggtgataactatgaaatgaaggaaataatagatcttcagcagtacaagatagccaataatcctacaaccgataaagaaaacaaaaagtggtcttatggcttctacctcatccatacccaaggacaaaatgggttagaattttattgcaaaacaaaagatttaaagaagaaatggctagaacagtttgaaatggctttgtctaacataagaccagactatgcagactccaatttccacgacttcaagatgcataccttcactcgagtcacatcctgcaaagtctgccagatgctcctgaggggaacattttatcaaggctatttatgttttaagtgtggagcgagagcacacaaagaatgtttgggaagagtagacaattgtggcagagttaattctggtgaacaagggacactcaaactaccagagaaacggaccaatggactgcgaagaactcctaaacaggtggatccaggtttaccaaagatgcaggtcattaggaactattctggaacaccacccccagctctgcatgaaggaccccctttacagctccaggccggggataccgttgaacttctgaaaggagatgcacacagtctgttttggcagggcagaaatttagcatctggagaggttggattttttccaagtgatgcagtcaagccttgcccatgtgtgcccaaaccagtagattattcttgccaaccctggtatgctggagcaatggaaagattgcaagcagagaccgaacttattaatagggtaaatagtacttaccttgtgaggcacaggaccaaagagtcaggagaatatgcaattagcattaagtacaataatgaagcaaagcacatcaagattttaacaagagatggcttttttcacattgcagaaaatagaaaatttaaaagtttaatggaacttgtggagtactacaagcatcattctctcaaggaagggttcagaaccttagatacaactctgcagtttccatacaaggagccagaacattcagctggacagaggggtaatagagcaggcaacagcttgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatcttaatacacttttgctttattctcacatgccattcaccagattatttgatggtacaaagaagcagaagtgtaattttccttttcccagcatgacgaaaaattggagttctgccatttgagcagcttactggagagatccagccttacttgtcttaaattgtccaacaaggtgactcattgcccggcaaacacttttaccctcagatgttactcatgatattataaaatatgaggccagtgctcaggtttgcatcataagtgagctatccctgaagggttttaattacttatttggtgtcctgattatatttgcaaacttctttataaaaggtgaaaaaagcacacaaaagagagggtgtcttcatattaaaccttcacaaccttcatgatttcataggattattttggaaatatagcacttgactttatgaaaggatctgggctaggtatattaggggtagttgccaataacctgaagaagctggcattgtttacagaaacagatcaagggctataatttatgtcattttatagcagcagtatctattaatacatgccttttcctcccatccacctcccccgcacacacacaaagatgacctgggacatgatttttttattcccacattttcttggagcacaaacaactttgttgaggattttggaaggaaagcacaactgggtcctttattcatttctgggacagaaagagggtcagtggacttttgtgggcctccagcttctctcagagtctccccctctgcagcccatcctgggagtgtattaactggagggaagatgggtcttgcagtacatttgttttgcccagccatcactcttttttgtgaggagcctaaatacattcttcctggggtccagagtccccattcaaggcagtcaagttaagacactaacttggccctttcctgatggaaatatttcctccatagcagaagttgtgttctgacaagactgagagagttacatgttgggaaaaaaaagaagcattaacttagtagaactgaaccaggagcattaagttctgaaattttgaatcatctctgaaatgaagcaggtgtagcctgccctctcatcaatccgtccgtctgggtgccagaactcaaggttcagtggacacatccccctgttagagaccctcatgggctaggacttttcatctaggatagattcaagacctttacctcagaattatgtaaactgtgattgtgttttagaaaaattattatttgctaaaaccatttaagtctttgtatatgtgtaaatgatcacaaaaatgtattttataaaatgttctgtacaataaagttacacctcaaagtgtactcttggaatggattctttcctgtaaagtcttatctgcgactctgtctcgggaatgttttgtctgttgccgtcagccgaactttgttatggagggagcagcctcacacaagcagaaacactcctgtggatggtattgtagcatgtattgtttattttagtcaatagaccctctccttataaatggtgtttagtcttcctgttgcatttcatgggcctgggggtttcctrgcagaggatattggagcccctttttgtgacattaccaattacatctttgtccacgtttaatactttgttttggaaaatttaaatgctgcagatttgtgtagagttctaataccaaagacagaagtaaatgttttccatatactttgtcttgcctgtatgcagcccttgtgtaatatggtgaattagagtggtatttcactttgtattattttgtaaatatgtcaatataataaatagtgactaaaaaaaaaaaaaa

SEQ ID NO: 1245 - DNA, 2148 bp, Homo sapiens
gcttcagggtacagctcccccgcagccagaagccgggcctgcagcccctcagcaccgctccgggacaccccacccgcttcccaggcgtgacctgtcaacagcaacttcgcggtgtggtgaactctctgaggaaaaaccattttgattattactctcagacgtgcgtggcaacaagtgactgagacctagaaatccaagcgttggaggtcctgaggccagcctaagtcgcttcaaaatggaacgaaggcgtttgtggggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactagctgggtgcacatatcaaatgcttcattctgcatacttggacactaaagccaggatgtgcatgcatcttgaagcaacaaagcagccacagtttcagacaaatgttcagtgtgagtgaggaaaacatgttcagtgaggaaaaaacattcagacaaatgttcagtgaggaaaaaaaggggaagttggggataggcagatgttgacttgaggagttaatgtgatctttggggagatacatcttatagagttagaaatagaatctgaatttctaaagggagattctggcttgggaagtacatgtaggagttaatccctgtgtagactgttgtaaagaaactgttgaaaataaagagaagcaatgtgaagcaaaaaaaaaaaaaaaaaa

SEQ ID NO: 1246 - DNA, 1348 bp, Homo sapiens
caggtggcgtacttggcttggagactggcgcggcgttcgtgtccgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaac

SEQ ID NO: 1247 - DNA, 1450 bp, Homo sapiens
ccaggcagcagttagcccgccgcccgcctgtgtgtccccagagccatggagagagccagtctgatccagaaggccaagctggcagagcaggccgaacgctatgaggacatggcagccttcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtccccgccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctcttgattcgtaggaattgaggagtgtctccgccttgtggctgagaactggacagtggcaggggctggagatgggtgtgtgtgtgtgtgtgtgtgtgtgtgtgtgcgcgcgcgccagtgcaagaccgagactgagggaaagcatgtctgctgggtgtgaccatgtttcctctcaataaagttcccctgtgacactcaaaaaaaaaaaaaaaaaaaaaaaaaaaaaaaaaaaaaaaaaaa

SEQ ID NO: 1248 - DNA, 878 bp, Homo sapiens
cagattttcaggttgattgatgtgggacagcagccacaatgaggaactcctatagatttctggcatcctctctctcagttgtcgtttctctcctgctaattcctgaagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaa

SEQ ID NO: 1249 - DNA, 3846 bp, Homo sapiens
gcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgagctccagagtcaggtgcgctacaaggaggagtttgagaagaacaagggcaaaggtttcagcgtagtggcagacacgcccgagctccagagaatcaagaagacccaggaccagatcagtaatataaaataccatgaggagtttgagaagagccgcatgggccctagcgggggcgagggcatggagccagagcgtcgggattcacaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggtgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccggagcgcccccatctgtcttcagcacattccacggcatcgcatccgtcctgggcgtgagccgtccattcttcagtgtctctgttttttaaaacctgcgacagcttgtgattcctacccctcttccagcttcttttgccaactgaagccttcttctgccacttctgcgggctccctcctctggcaggcttcccccgtgatcgacttcttggttttctctctggatggaacgggtatgggcctctctgggggaggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagggaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtggaggaagcccaccaatctgccctttgcagtgtgtcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtgggccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataattttta

SEQ ID NO: 1250 - DNA, 1414 bp, Homo sapiens
ggaattccggaattccgcggagcaggcctcgtgccgttacggccatcacggccgccgcagtggcgtcctggagccctcctcagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcgccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaattgaagactgagaaaatgttgggtccagtcgtgcttgattggaaattgttgtttctaaatctatatgagatttgacatagtattttattatactcagccatacatatatactatgtatgagcagtg

SEQ ID NO: 1251 - DNA, 3198 bp, Homo sapiens
ttgggaggagcagtctctccgctcgtctcccggagctttctccattgtctctgcctttacaacagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttacctt

SEQ ID NO: 1252 - DNA, 2568 bp, Homo sapiens
atggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccatcgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttcgcagagcagccttttgagaaagctgccttccagaaacagaatgatacccccaagggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctggccactga

SEQ ID NO: 1253 - DNA, 6577 bp, Homo sapiens
tgccgcttccgcggtcacatgactccagtctagctcgcattgcgctcccgccggcgagttctccccgcgcgccgttgcgaggagacggcgcatgtccgccgcgcttgcccctctgcagtaccccgccctcttctccaccacaatgagatctaagtgcgtgctgcgcgtgcgtacgtgaggtcgaaaagcgcactgggacggcagccaggaaacgtgtgggcctctctgctgcggtctccgagggccgaccgctgccggcgcgggtcgtgcgggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagaggagctctacagggacggcaggctgcacttctagctctgcaacataaagcagacgaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttgtctaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacgtgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcacgagaaaattcaagcattgcaaacggcatgccctgacttacagctgtcagctgctagtgtgggtaactgtcctaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatcgaaaggaaactaaaaatacgtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatccagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccaacgaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagccagaattctttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctcttcaagcaaaagtattcagcagaaagaatcatgagcaactggaaaaaataataaaatgtaataggtctacagaaatatcttcagaaactgggagtgatttttccatgtttgaagctttgcaggatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtccattggaacgagaagccactagtaaaaatgaccaaaaataactgtcctgtgaaacccagttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatgtgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatct

SEQ ID NO: 1254 - DNA, 1745 bp, Homo sapiens
tggaagcagcgtaaaggatggacaggaatgcagaggtaggcaggaggaccagcagtgtgactgctgaaacccaggggagggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcc

SEQ ID NO: 1255 - DNA, 1368 bp, Homo sapiens
ccgcagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtc

SEQ ID NO: 1256 - DNA, 1750 bp, Homo sapiens
gtggccgccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacc

SEQ ID NO: 1257 - DNA, 3314 bp, Homo sapiens
gaattccggcaggcgcccatggcgggctgagtcctgcccatgccctggtggcctggaagcctgcatgggcgccgtgcaaagatcaacgttttccagaggagcttttgggctcatcactggcctggggagggcttgacacggggttcccacagcttgccccacaccaccttcacacccacacacagcaggtccccgcggggccggtgcaggctgtggctgcccgcgctgcgctgttgctctgtcccggctggctggctccgagtgtggggcgctctgggccggggccgctggggcgcgcacagtggggtgacaggcggcctggctgcagaaacgttgcaccggtgcctgaggtgggaggatgtgatgacgcggcccacgcagcgggaacccaggcctttaaaaagcccaggaaacagcctcagctcaagcggtggctccactggaggaaaacacaccccggtctcacattaaagaagccaaactgtcggcttcaaagagaaaaggcaacatcctgtcacaggccatgctctggcaaaaacccacagctccggagcaagccccagccccggcccggccataccagggcgtccgtgtgaaggagccagtgaaggaactgctgaggaggaagcgaggccacgccagcagtggggcagcacctgcacctacggcggtggtgctgccccatcagcccctggcgacctacaccacagtgggtccttcctgcctggacatggaaggttctgtgtctgcagtgacagaggaggctgccctgtgtgccggctggctctcccagcccaccccggccaccctgcagcccctggccccatggacaccttacaccgagtatgtgccccatgaagctgtcagctgcccctactcagctgacatgtatgtgcagcccgtgtgccccagctacacggtggtggggccctcctcagtgttggcctatgcctctccgccactcatcaccaatgtcacgacaagaagctccgccacgcccgcagtggggcccccgctggagggcccagagcaccaggcacccctcacctatttcccgtggcctcagcccctttccacactacccacctccaccctgcagtaccggcctccggccccagccctacctgggccccagtttgtccagctccccatctctatcccagagccagtccttcaggacatggaagaccccagaagagccgccagctcgttgaccatcgacaagctgcttttggaggaagaggatagcgacgcctatgcgcttaaccacactctctctgtggaaggcttttaggcgtggctcccacctgagtcctgttccctgaaactgggattttaaaatgagcctggaattgagccccaggttcatgcttgtttggagtagtcatttcatgactactctttctacgcacagctagaattgtagacctgtaaaccttccttcccttcttccttcccctccctccctcacttcctccctctcccccatccttccattcttcccctccctcccttcttcctttccaaccccttccttccttttcctccctcccttccttccctccttcccttctccctttccaaccccttccttccttttcctccctcccttccttccctccttcccttctccctttccttctttacctccctccctccctcgcttcttctctctttcttacttcttttttcaattctgttccattttgggaggtaattatagggattttagcaataacattttatgtcaaatgttgccaagtctgtggtccatgggctttcatttctgtcacatttcatttcttggaaaaggcctccttcctccagtgcctgctgaaccatcttagggtcactcacaccctctgtaattttaagatgtatgtggtggccggcgggaagaccagccccgacagcacctcctgagaaagtcagccaagggcctaccctgatgccagagtccttgagctgtcagttcccacagttgctcctttgtttgctcttctcagcctcggccagatttacagtccaggcagcaaaatctcaaggcctggggctcagagtagtaaggggtgggaagtgggtggcagggagaaaagaacatcagggtgggtggggacaggccagtgacgaagagagggacagaggagggatgggaacaggctgtgcatcttagttggagagaggggtgtgggaggaagcttgagtttgatgcagggaggaggaaggctgaggaatgacttggctccagattacttggttattaagaagaacaataaactaaaggaaagcattgcttgaagagatggttttgctgctctccttgaggatacgtgcaagggaagttgggctgttgtaaacagggtgaagggtgtgtttggtcggccatttctctctcacctctaggccctctgctggtgctgtggaggccaagaccccattaagcctaaaggtgatgggtcctcgcctaggcttagtgctaccatgtgggttttgtttctttccttccttccttccttccttccttccttccttccttccttccttccttccttccttccttccttctttccttccttccttccttccttccttcctctctctttctttcttttttttggttttttttgggacggagtctcactccattgcccaggctggagtacaatggtgcgatcttggctcactgcacctctgtctcccaagttcaagtgattctcctgcctgagcctcccgagtagctgggattacaggtgcatgccaccatgcctggctaatttttgtatttttagtagagacggggtttcaccatgttggccaggctggtctcgaactcctgaccttgtgatccgcgcgcctcagcctctcagagtgctgggatcacaggcgtgagccaccgcacccagccttttaccatgtgggtttctttagtgtcttaaaagcgtccataagccaccattctgtggaaccaaggccccctccacgcaaacaccctccctcctggggacctctggagcctcagccagaagtaccattaggtttaattttaatttgttttgctggagaaacatcaggtttgtaggagactgagttgttagcaggtgtgcttagctcttgatagtgaacgtgtaccttgggaactggctcacccacctgctaatagcaccatcgtcactattaagcagacatttcagttggtagaatccatgtagaagtcatggacttttctgggaaatgacttttctgggaaatgacagtttctttgacatattttctttgcccactttaaataaaaactctggagaaaaaaaaaaaaa

SEQ ID NO: 1258 - DNA, 3120 bp, Homo sapiens
ccgcagagggccggggctacggggcagccccgggcgatgaggggccggcgttgaccgggaagagcgggcaccgcggcagtggctccgaggggacccgcgatggcagcgccctgagaggaggctccaggcagggcgggctgcgctggcagcggccgctgaggtgctggccggccggctggctggcgacgggggcagaagcgacgagaggcgcgctcggcacccgcacccccgtgcccccgcctcagttgtctaaacttcgggctctcttccaccgtctgcgcgcccagagtcaacaacttcttcacccccctccgcccccgcccttccctccgtcagccccgggagctcgccgcggcccggggaccaggaacctccagcgctgagatgtggccgtgaggcgttggcgggcgccgaggagaagctcggcggcgtcccggggccggagggccgtggggccggggcgcaggggcgcgagcaccccgcgcctctcccccgcctcctcctgccgtctccgccgctgcccgtgccttgcaagcagcagccggagctgccaagcgtcagggccgcggagatgtcgtcgtcgtcgccgccggcgggggctgccagcgccgccatctcggcctcggagaaagtggacggcttcacccggaaatcggtccgcaaggcgcagaggcagaagcgctcccagggctcgtcgcagtttcgcagccagggcagccaggcagagctgcacccgctgccccagctcaaagatgccacttcaaatgaacaacaagagcttttctgtcagaagttgcagcagtgttgtatactgtttgatttcatggactctgtttcagacttgaagagcaaagaaattaaaagagcaacactgaatgaactggttgagtatgtttcaactaatcgtggtgtaattgttgaatcagcgtattctgatatagtaaaaatgatcagtgctaacatcttccgtacacttcctccaagtgataatccagattttgatccagaagaggatgaacccacgcttgaggcctcttggcctcacatacagttggtatatgaattcttcttgagatttttggagagccctgatttccagcctagcattgcaaaacgatacattgatcagaaattcgtacaacagctcctggagctttttgatagtgaagatcccagagaacgtgacttcctgaagactgttctgcaccgaatttatgggaaatttcttggattaagagcattcatcagaaaacaaattaacaacattttcctcaggtttatatatgaaacagaacatttcaatggtgttgctgaacttcttgaaatattaggaagtattatcaatggctttgcattgccactgaaagcagaacataaacaatttctaatgaaggttcttattcctatgcatactgcaaaaggattagctttgtttcatgctcagctagcatattgtgttgtacagttcctggagaaagatacaacactaacagagccagtgatcagaggactgctgaaattttggccaaaaacctgcagtcagaaagaggtgatgtttttaggagaaattgaagaaatcttagatgtcattgaaccaacacagttcaaaaaaattgaagagccacttttcaagcagatatccaagtgtgtatccagttctcattttcaggttgcagaaagggcattgtacttctggaataacgaatatattcttagtttgattgaggagaacattgataaaattctgccaattatgtttgccagtttgtacaaaatttccaaagaacactggaatccgaccattgtagcactggtatacaatgtgctgaaaaccctaatggaaatgaatggcaagcttttcgatgaccttactagctcatacaaagctgaaagacagagagagaaaaagaaggaattggaacgtgaagaattatggaaaaaattagaggagctaaagctaaagaaagctctagaaaaacagaatagtgcttacaacatgcacagtattctcagcaatacaagtgccgaataaaaaaaaagcctcccacctctgccggataggcagagttttgtatgcttttttgaaatatgtaaaaattacaaaacaaacctcatcagtataatataattaaaaggccaattttttctggcaactgtaaatggaaaaatatatggactaaacgtagccctgtgctgtatcatggccatagtatattgtaacctttgtctaatcattggatttattgtgtcacttctgaagtttcacagaaatgaatgaattttatcatctatgatatgagtgagataattatgggagtggtaagaattatgacttgaattcttctttgattgtgttgcacatagatatggtagtctgctctgtatatttttcccttttataatgtgcttttcacactgctgcaaaccttagttacatcctaggaaaaaatacttcctaaaataaaactaaggtatcatccttacccttctctttgtctcacccagaaatatgatggggggaattacctgccctaacccctccctcaataaatacattactgtactctggaatttaggcaaaaccttaaatctccaggctttttaaagcacaaaatataaataaaagctgggaaagtaaaccaaaattcttcagattgttcctcatgaatatcccccttcctctgcaattctccagagtggtaacagatgggtagaggcagctcaggtgaattacccagcttgcctctcaattcattcctcctcttcctctcaaaggctgaaggcagggcctttccagtcctcacaacctgtccttcacctagtccctcctgacccagggatggaggctttgagtcccacagtgtggtgatacagagcactagttgtcactgcctggctttatttaaaggaactgcagtaggcttcctctgtagagctctgaaaaggttgactatatagaggtcttgtatgtttttacttggtcaagtatttctcacatcttttgttatcagagtaccattccaatctcttaacttgcagttgtgtggaaaactgttttgtaatgaaagatcttcattgggggattgagcagcatttaataaagtctatgtttgtattttg

SEQ ID NO: 1259 - DNA, 8062 bp, Homo sapiens
cgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctagatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatg

SEQ ID NO: 1260 - DNA, 3647 bp, Homo sapiens
agtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgt

SEQ ID NO: 1261 - DNA, 607 bp, Homo sapiens
ggactgttgaagacaggtctccacacacagctccagcagccacatttgcaaccttggccatctgtccagaacctgctcccacctcaggcccaggccaaccgtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccataaccccacccttgcccaccccacccccacccccaccaagggcgcaagagtagcggtccaagcctgcaactcatctttcattaaaggcttctctctcaccagcaaaaaaaaaaaaa

SEQ ID NO: 1262 - DNA, 687 bp, Homo sapiens
cattcccagcctcacatcactcacaccttgcatttcacccctgcatcccagtcgccctgcagcctcacacagatcctgcacacacccagacagctggcgctcacacattcaccgttggcctgcctctgttcaccctccatggccctgctactggccctcagcctgctggttctctggacttccccagccccaactctgagtggcaccaatgatgctgaagactgctgcctgtctgtgacccagaaacccatccctgggtacatcgtgaggaacttccactaccttctcatcaaggatggctgcagggtgcctgctgtagtgttcaccacactgaggggccgccagctctgtgcacccccagaccagccctgggtagaacgcatcatccagagactgcagaggacctcagccaagatgaagcgccgcagcagttaacctatgaccgtgcagagggagcccggagtccgagtcaagcattgtgaattattacctaacctggggaaccgaggaccagaaggaaggaccaggcttccagctcctctgcaccagacctgaccagccaggacagggcctggggtgtgtgtgagtgtgagtgtgagcgagagggtgagtgtggtcagagtaaagctgctccacccccagattgcaatgctaccaataaagccgcctggtgtttacaactaattg

SEQ ID NO: 1263 - DNA, 2820 bp, Homo sapiens
ccgcggagttacgggaaagttggtccgagttcccagagtttccctctgtggtgccctaggcttcggcccggtgccccggctcctttcctcctttcggccttcgccgtccaccaggtccctctctctgtcccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacattaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgacgaacagcaacgagaattggaagaggaagaagaaaattcggatgaagatgagctggattcccacaccatggtgaagactagtgtgggagagtgtggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaaggctattgttgcattgtacagcactgaaagggctttatgttacaatattctttattcctatctagtatactaggctatttattgtccccttaggtaaacttatttatttatgctattttggctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaaaagattaaaaccattaaaaagaaactcatttttacgctgaatgaacatttatatgattgcattgggaccagtcatttcctaagctacatatggccatcttgacagtgttttttcttttgtgtgtttaattattatgtgtaaatcataaagacaaataaatttcactgtgccac

SEQ ID NO: 1264 - DNA, 915 bp, Homo sapiens
atgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatgggggatgtgaaggaaatcagaatcgatttgaaagtctggaagagtgcaaaaaaatgtgtacaagagataatgcaaacaggattataaagacaacattgcaacaagaaaagccagatttctgctttttggaagaagatcctggaatatgtcgaggttatattaccaggtatttttataacaatcagacaaaacagtgtgaacgtttcaagtatggtggatgcctgggcaatatgaacaattttgagacactggaagaatgcaagaacatttgtgaagatggtccgaatggtttccaggtggataattatggaacccagctcaatgctgtgaataactccctgactccgcaatcaaccaaggttcccagcctttttgaatttcacggtccctcatggtgtctcactccagcagacagaggattgtgtcgtgccaatgagaacagattctactacaattcagtcattgggaaatgccgcccatttaagtacagtggatgtgggggaaatgaaaacaattttacttccaaacaagaatgtctgagggcatgtaaaaaaggtttcatccaaagaatatcaaaaggaggcctaattaaaaccaaaagaaaaagaaagaagcagagagtgaaaatagcatatgaagaaatttttgttaaaaatatgtga

SEQ ID NO: 1265 - DNA, 4426 bp, Homo sapiens
tgccttgaccaggacttgggactttgcgaaaggatcgcggggcccggagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttcctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattattt

SEQ ID NO: 1266 - DNA, 4180 bp, Homo sapiens
ccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccggggacctcggggctggcggccacgcgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtggagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcgttagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacctggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatatttttgtggatacagggtctcattctgttgcctaggcttgtctggaactcctgggctcaagggatcttgtagccttagcctcctaaagtgctgggattataggcatgagtcactcgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcgatctcaggcatgactcagcccggctgatgcctctgcagtgctgagtcaggatttggggccggctctcttgggtctgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtgaaaaa

SEQ ID NO: 1267 - DNA, 1833 bp, Homo sapiens
ctgcactgcgaggccgacgcagctggagagaagttaggcaggtcctagggagggcaggctcgagtgctgggcccgcctccccgcgggactgtaggcccgggggctccgcctcgtcgcagcggcagaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatgtaaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagtttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagt

SEQ ID NO: 1268 - DNA, 509 bp, Homo sapiens
attctttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataaaaaaaaaaaaa

SEQ ID NO: 1269 - DNA, 2530 bp, Homo sapiens
aaaacaggagctgattcgagctggcagagctgggccatggaaccggtagagacctggacccccggaaaggtggcaacttggctgagaggtcttgacgactccctgcaggactatccctttgaggactggcagctgcctggcaagaacctgctccagctctgcccccaaagcctcgaggctctggctgtgcggtctctgggacaccaggagctcatcctgggcggggtggaacagctccaggccctgagctccaggctacagacagagaacctgcaaagcctgacagagggacttctgggggcaacccatgacttccagagcatagtccaaggctgcctgggggactgtgccaagacccctattgatgtcctctgtgcagctgtggagctgttgcatgaagctgacgccctcctcttctggctcagcaggtacctcttctcccacttaaatgatttctcagcatgccaggagatccgagacttgttggaggagctgagccaggtcttgcatgaggatggtccagcggctgagaaggagggcacagtcctgaggatctgcagccacgtggctgggatctgccacaacatcctggtctgctgccccaaggagctgctggaacagaaggccgtgctcgagcaggtgcagctggacagtccattgggcctagaaattcacaccaccagcaattgccagcactttgtgtcccaagtggacacccaggttcccactgactcccgactgcagatccagcctggagacgaggttgtccagatcaacgagcaggtggtggtgggatggccccgtaagaacatggtgagggaactgctgcgggagccagccggactcagcttagtgctgaagaagatcccgataccggagacccccccacagacgccccctcaggtcctggactccccgcaccagaggagcccatcactgtctctggccccactgtctcccagggccccatctgaagacgtctttgcctttgacctgtcttcaaaccccagtcccggacccagccctgcctggacagactctgcctcccttggccctgagcccctgcccatccccccggaacccccagccatactcccagcaggggtagcagggactccagggctccctgaatcccctgacaagagtcctgttggtcggaagaaatcaaaaggcctggcgacccggctgagccgccggcgggtgtcatgccgtgagctgggccggccggactgtgacggctggctcctgttgcgaaaggcaccgggcggcttcatgggcccgcgctggcgccgccgctggtttgtgctcaagggacacacgctctactggtaccgccagccccaggatgagaaggctgagggcctcatcaatgtctccaactatagtctggaaagtggacatgatcagaagaagaaatatgtgtttcagctcacccatgatgtgtacaaacccttcatcttcgctgctgataccctgacagatctgagcatgtgggtgcgtcatctcattacctgcatctccaagtaccagtctccaggccgggcccccccaccccgagaggaagactgctacagtgagaccgaagcagaggacccggacgatgaggctgggtcccactcagcctcgcccagccctgctcaagctgggagtcccctccatggagacacatcacctgcagccacccccacacagcgcagcccacggacctcctttggctctctgacagacagcagtgaagaggcactggaaggaatggtacgggggctgaggcagggtggcgtgtccctcctaggccagccacagcccctgacccaggaacagtggcggagctctttcatgcggcgcaaccgagaccctcagctcaatgagcgagtgcaccgtgtgcgggcgctacagagcacactcaaggcaaagctgcaggagctgcaggtcctagaagaagtgctgggtgaccctgagctgacaggagagaagttccgccagtggaaggagcagaaccgggagctgtactcagagggcctgggggcctggggagtggcacaggctgaaggcagctcccacatcttgacctctgactccacagaacagtcccccaactccctgccctctgaccctgaagagcactcccatctctgccccctgacctcagagagcagcctccgacctcctgacctctgaccctggccagcactctagctcctgacctttgacccgagggccacctcaaccccagcttctgacgtgtccaggacagagcatccctggattctgttcagggtgggaagtagtactgctagtcatggtctcaccccgagctgacccctctgcctgggctttgtgccaccctctcccttgccaaagaagaaactctccccccaaatcctccaacctctggggccacagccctgcccctccagttccttggcagttctcccccaaaccaggtctgtacaggtgttctttattttacatgagggctactttccaaccaaataaagtcaatttttctaagaaaaaaaaaaaaaaaaaa

SEQ ID NO: 1270 - DNA, 1032 bp, Homo sapiens
ggagggtgggcagcactcgctttattgtccagcattccacatggatagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgtcggtgccctacggaaacgcacaggaacaaaatgtcagtggcaggtgggagttcaagtgccagcttggagaagaggagtgcaaattcaacaaggtggaggcctgcgtgttggatgaacttgacatggagctagccttcctgaccatgtctggcatggcatggaagagtttgaggacatggagagaagtctgccactatgcctgcagctctacgccccagggctgtcgccagaactatcatggagtgtgcaatgggggaccgcggcatgcagctcatgcacgccaacgcccagcggacagatgctctccagccaccgcacgagtatgtgccctgggtcaccgtcaatgggaaacccttggaagatcagacccagctccttacccttgtctgccagttgtaccagggcaagaagccggatgtctgcccttcctcaaccagctccctccggagtgtttgcttcgagtgttggccggtgggctgcggagagctcatggaaggcgagtgggaactcggctgcctgcctttttttctgatccagaccctcggcacctgctacttaccaactggaaaattttatgcatcccatgaagcccagatacacaaaattccacccctagatcaagaatcctgctccactaagaatggtgctaaagtaaaactagtttaat

SEQ ID NO: 1271 - DNA, 1294 bp, Homo sapiens
cccacagctgcctccatttccttaaggaagggtttttttctctctccctcccccacaccgtagcggcgcgcgagcggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctgaaggaaaaaaaaaaaaaaaa

SEQ ID NO: 1272 - DNA, 1517 bp, Homo sapiens
attctttggggaggcaactaggatggtgtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaagaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaa

SEQ ID NO: 1273 - DNA, 2221 bp, Homo sapiens
cgcgggggcgggcgcgcaccgggagcgcgtcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagccaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatcaaaaaaaaaaaaaaaaaa

SEQ ID NO: 1274 - DNA, 6330 bp, Homo sapiens
agtcccagcctgccggccggtactcaccgctacccggagttcgctcagacggtgagatttggggcgggtccgaggcagcggcgggacgtacctgcgaccgggaccatgaggagctgccagacccgtggggccggtaacgagagcagtcgcggcacctgctgagaggaaagagggagcggtcccgcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaagtggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagccgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagaggtttgtgcgctcgcagaccacccaagggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttactcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaagaggttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggcctgaacaaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagcaaaaaaaaaaaaaaaaaaaaaaaaaaaaa

SEQ ID NO: 1275 - DNA, 4157 bp, Homo sapiens
ctgagccgcatctgcaatagcacacttgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttaaaaaaaaaaaaaa

SEQ ID NO: 1276 - DNA, 1231 bp, Homo sapiens
gccaccatggggaacaagcagaccatcttcaccgaagagcagctagacaactaccaggactgcaccttcttcaataagaaggacatcctcaagctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggatggtgacggcaagctgggctttgctgacttcgaggacatgattgccaaggcccctgacttcctcagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtggcgccaagggctcttgctcctgtctctgcctctgggtcatgagtaccaccctgcctgcctccccaacaccgtggaatcctcactggtgtgctgtccacagatttgtgaactcctggtagtaaaacacttttgcatcca

SEQ ID NO: 1277 - DNA, 4552 bp, Homo sapiens
agcgcccgccgcgtccggggccggctggtgcgcgagacgccgccgagagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatgcagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttgccacattggcagagatgggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctac

SEQ ID NO: 1278 - DNA, 8034 bp, Homo sapiens
cttgagtgttagagctgagtagttttcccagaatctctaagtcctttttatgctcttttatgaatgaatagaattagtaaaagataaataaattttttcttttggatttcttaaccagtggaaaaaatgttgactttaaaagttcataaaatcaaattttgcttaagaatatgttatttccacttgtgaggccagcctggtagacctctgggatccttttctgttcactcacacaccactgagataaggagtgaagtgtgggctaaatagggctgaggcttgggcaagggcatttctgccagagcaccagagacgtcagcatctcaagggcactgtggtatggaaaaggacgccacatgagtaaattttaaaaatataaatattttaaagggtaaaaatgagggtccctgtatttgaggatataaaagatgaaactgaagaagaaaagataggggaagaagaaaatgaagaagaccaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgccaaaggattctcagattatgcccacatgaaggagccccctgaggttaaacatgccatggaggtcaataaacaccagagtaatatttcttataggaaagacgtgcaggacacccacacgtacagtgcagaacttgaccgaccagacatcaagatggcaacccagatctctaagatcataagcaatgcagaatacaagaaaggacaaggaataatgaataaagagcccgctgtaattggaagaccagattttgaacatgccgtggaagcttctaaactttctagtcaaattaaatacaaagaaaaattcgataatgaaatgaaggataagaaacatcattacaatcctcttgaaagtgcttcttttaggcagaatcagcttgctgctacactggcgagcaatgtgaagtacaagaaagacattcaaaatatgcatgatccagtttcagatctcccaaatttgttgtttttagaccatgttttgaaagccagcaaaatgctcagcggccgagaatataaaaagctctttgaggaaaacaaaggaatgtatcattttgatgcagatgctgtggaacatctgcaccataaaggcaatgccgtcctccaaagtcaggtgaaatataaagaagaatatgagaaaaataagggaaagccaatgcttgaatttgttgagacaccatcatatcaagcttcaaaggaggctcaaaagatgcaaagtgaaaaagtttacaaagaggattttgagaaggagattaaaggaaggtcatcactggatttagacaagactccagaatttttacatgtaaagtacatcaccaaccttctgagggagaaagaatataaaaaagatttggaaaatgagataaaagggaaaggaatggaacttaattcagaagttcttgatatccaaagagcaaagcgggcctctgaaatggcaagtgagaaagaatacaagaaagacctggagtcaataattaaagggaaaggaatgcaagctggcactgacacccttgaaatgcagcatgccaagaaggctgcagagatagcgagtgagaaagactataaaagagatctggagactgaaattaaagggaaagggatgcaggtgagcacagacactcttgatgtccagagagctaagaaagcatccgagatggccagccagaaacaatacaagaaggacttagaaaatgaaattaaagggaaaggaatgcaagtgagcatggatatcccagatatccttcgagccaagaggacatctgaaatctatagccagagaaagtataaagatgaagcagagaagatgctttctaactattctaccatagcagatactcctgaaattcagagaattaagacaactcaacaaaacattagtgcggtattttataagaaagaagtgggagctggcactgcagtgaaagatagcccagagatcgaacgagtgaagaaaaatcagcagaatattagttcagtgaaatacaaagaagagattaaacatgcaacagccatttctgatcctccagaactaaagagagttaaagaaaaccagaagaacatcagcaatctccagtataaagagcaaaactacaaggccactccggtaagcatgaccccggagatagagagagtgaggcgaaaccaggagcagctgagtgcggtaaaatataagggagaacttcaacggggaactgcaatttctgatccaccagagctgaagagggcaaaagaaaaccagaaaaacatcagcaatgtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttgacctcaaagtttggcgcacagatcctggctccatcttcgaccttgatcccctggaagacaatattcagtctagaagtctccatatgctctctgaaaaggcgagtcactataggcgacactggtctcgatcccattccagcagtactttcggtacaggtctcggagacgacaggtcagaaatctccgagatttaccctagcttttcatgctgcagtgaggtaacaagaccgtctgatgaaggagcacctgttcttcccggagcctatcagcaaagccattcccaaggctatggctacatgcaccagaccagtgtgtcatccatgagatcaatgcagcattcaccaaatctaaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacgcctggtgctgctaattgtgttcatggtttcctttgattggctattgaacccttctgggaaatgtatttttgtagactttaatagagaagttgattgtcccttaaatgtagcgtgtgtttgaaacttcttagctgtcactttggaatcaccccaagccaattctcttaactctgtaatgcagccaataatacaaacccgttttgcttttgagtcatgaggcaatttccaatattagtgaaaattgcccaatataataagtgtaaacagtggcagaaggacagtctggttaaaattatattgactggtggccttagggatctagaaacttctactaaacagagaaatttccttgttccctaggctgactggtatctatttatttctcatttgtaccaaggcatctcctactctccatttatattctatggacccaagtctatgctcagttccacagaatgtcaggaccaaataacttcacagctactctgcaaagggcaaattataatgtcattgatataatttccctagtagcatttaccctgttgcatgtcatgtagattcaagcttctgtaacataggcagctgcactgcgcgttcctattattgaagcaaaaagggtgactgatacctaaaagccctttcttcctctagtcgccagctcatcagaaaaacatactttgaaaagatgcttgagattttcctgctgcatcgcactctagtttggaaggatttacatcttaggaaataacatgtatactctagtaaataagcgatttaggtgttccattgaacagctttgattaacttaatgccaccattgatttcaaagtgaagaaaatgtaacagaagccagtgaagcaatggaagctggagtgtgactggaaaaatactcagcaaacaaagttaccaattccatacagagatgatctggtgtcttcttttggaaaatggtattcaaattctggaatggaaatctagccaccaaaacgggttaatcaaaagacgtccttttccgttttttttgcttttattttctaaatcatttttaagggaatgaaacaggaatgtcatcagagattttttagtacaggcccaagagcctgtactctaagaaagaaatttttgccatgtatgaattttcgaataagtgactttgcaggcttttgctagcccttgctggtgggtctggaaattacatccagagtctgcagtccaggtcaccaagccagcggcacccgtcggcaaccctgtgtttaacggattgtgccgtttactgtgacctgcaacggggtggcattcacttagggtctgacttcacagctatgacaaaaccgaaaaagcaaaactgcgaggaagtgctaagatgtacgggtcttggggatatctgccttatatgttatattcaaggaaattaacgaaacatcctgtgaaacatcgtttaaggaaacgtttactagtccaaaggccaaagctaatttatttccactttagaaaagttagcacatgcttttgaaaatctgtgatttcattttattaggctaaaagggtaaataggctttattacactgaagctgcatctatatgtcactgacataaagttgaaaaaataaatgcaggcaaataactagagacttcttttaagggggtttggctggtttctctcactgaaatggccagtcgtgattaaagtgataaaaccccatatctgttttggtatattgtacacaaacctacaaaaataaactgaacttgcaatatttttgcaataaaatctgtcgttaaaactgaggataaaatacctgctcaattttattttactaagtatatatttacatttcacccaggcaggccattttcttttgtgattataagaaagagtagttgttgattaaattttcagactaaatataggacaggtacaattttggataaatagcagatttataagaaccgcaatgaaaactgacttgaaataatgcttgtaatcaggaaagtaatttcatccaccgatttcaaaaccagattcactgagcataaaagtcaatacatatttgaggaataagtctcctaaaattttaagcttcacgtaataatgtttgcatagcaaaatatttctgcttcaagcctttaggaattaagatctgatcagaatttaactaaagggtagttgttttacaatgaagactaaaactgaacaagatgttgcatgcgcttaggccataatttggtagtgttggcagttgttaataaagcttgtcaggatgttaagcatctcaggagaaatattggaaaattatatgtataaaaccaaagtgctgtttttaaaagcatcatttaaaaaaaaatgacatgcctgaacaacttttccactttccacgtgcttccctcccacctttggtttggcaacaggtatctcgtgcatgaagctgacagctaaagaagattttaaaaattgagttaaagatgactgtgtaaatgtccaagcacagagagcatgcacctgactttctaaagtttgatgtgttctcaagcctgacagaagcacaaggaacagtttgatacacttttaaaaggttctgaaaacaaagctgtatagggatcctctctctcttgagcaaagtatagcaacagaatatattgcttttgttgtaagcttttgtagtacatgtttttactaataattcttgttctctagaaagctttctatttctaacctatggcaaaatgaatccttcatgtcttcttgttattgtttacacacttgcagtgtagcccagtttgaaatatttatttggttatcaactgcccatggaggaggctcttgatgatcccaggtctcctcgacctccatacaccacacaggcatttgtaagcacagtttccacaagcaccttgtaggaatatggataagattagaccagcccctctctgtccactgggtttatttcttgaagaagatgcagatctggtttttccaatgtgccacagtctttccttatcctctccatgctgagcttgacaacactctgggaatgaggaacaagactttttctaaaaagatagtggaagttcaagggatgtacctcgttttcaggttcatccatctccagtggaatgttttcaataaaagatgaagaaaatgtgtgtgatctttaataacacatccctatagaaagtggataaaagatataccaaaactgtaatacagatatatacaaatataggtgcctttttgattactcttgtttgtctagtatgctcttggaaagaaaaccaagcaagcaagttgctgcctattctatagtaatattttattacacatgattgatatttttgtggtagggaagtgggatgctcctcagatattaaaggtgttagctgattgtattttatctctaaagatttagaactttagaaaatgccgacttcttccatctatttctgaaaggttctttgtggatttatatagagttgagctatataaacattaactttagatttgggatttaaaatgcctattgtaagatagaataattgtgaggctggattcactacacaagatgaacttcacttcataaattaattataccttagcgatttgcttctgataatctaaaagtggctagattgtggttgttttggttaaggtgatatggaggtgggagagcttttagttaagtaagaagctatgtaaactgacaaggatgctaaaataaaagtctctgaagtattccatgccttttggaccctttcctcgcaactaactgtcaactgttgatcaaaaaagtcaaggcattgtatgttgcttctgtggttattattctgtgatgcttagactacttgaacccataaacttggaagaatctttgagcaaattttctcagttgtctgtatgacttcagtatattcctgggaatgccataggattttttgtgcttgatacatggtatccagtttgcatagtatcacttctttgtaatccagttgctgttaagaatgatgtactttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgtggttgatgattaatttgcgagactaactttgagagtgtaacagttttgaagaaaacattgaatgttttacaaatgaaggggcttcacggaatgttacaatgttactaatataatttggcttttgttatgcaaattgttaacaccagctattaaaatatattttagtagaaaaaaaaaaa

SEQ ID NO: 1279 - DNA, 777 bp, Homo sapiens
ggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattc

SEQ ID NO: 1280 - DNA, 921 bp, Homo sapiens
gcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaataatcccagatccagctggaaagctgaagtatttcgataaactgaattgagaaatacttcttcaagttatgatgcttgaaagttctcaataaagttcacggtttcattacca

SEQ ID NO: 1281 - DNA, 1077 bp, Homo sapiens
accgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacatgttttagaaatttggtttcaagtgtacatgtgtgaaaacaatattgtatactaccatagtgagccatgattttctaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaaaaaaaaaaaaaaaa

SEQ ID NO: 1282 - DNA, 1050 bp, Homo sapiens
gtcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattgggcggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagctctttggctccttaccagactcttgggccagggggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggagaaataaagatttgtcagcccaa

SEQ ID NO: 1283 - DNA, 991 bp, Homo sapiens
aacggattcgccatcgtgagttccaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgataatctgaaggagaagaaaacagatgctaagcagcaagtgtcagggtggacgcctgcacacgtcaggaagcagcttgtcattggcgttaacgaagttaccagagccctggaaaggagggaactgctgttagttctggtgtgtaaatcagtcaagcctgccatgatcacctcacacttgattcagttaagcctaagcagaagtgtccctgcctgtcaggtcccccggctcagtgagagaatcgcccccgtcattggcttaaaatgtgttctagccttggcgttcaaaaagaacaccactgactttgtggacgaagtaagagccatcatccccagagtccccagtttaagtgtaccatggcttcaagacagaattgaagattctggggaaaatttagagactgaacctctggaaagccaagacagagagcttttggacacttcatttgaagatctgtcaaaacctaagagaaagcttgctgacggtcggcaggcttctgtaacattacaaccccttaaaataaagaaactgattccaaaccctaataagataaggaaaccacccaaaagtaaaaaagctactccaaagtaatcttgcataaacttgtcatgtcatacagtttgtgaaaggacaccttgtaaagaagccttgaaactaataaaatgagttatacttacataaaaaaaaaaaaaaa

SEQ ID NO: 1284 - DNA, 1335 bp, Homo sapiens
atggcagtgacaactcgtttgacatggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctcctcctgggtccaattggagctcccaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcaaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatag

SEQ ID NO: 1285 - DNA, 1883 bp, Homo sapiens
atgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctagcattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgta

SEQ ID NO: 1286 - DNA, 3624 bp, Homo sapiens
gcaggttgggagggaaagtcgggggaggacgcggaagaggagctgtgggaagggggaggagggagggaggaaaagaggaggagacggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtgcctctcgcgcatggaggacgagaacaaccggctgcggctggagagcaagcggctgggtggcgacgacgcgcgtgtgcgggagctggagctggagctggaccggctgcgcgccgagaacctccagctgctgaccgagaacgaactgcaccggcagcaggagcgagcgccgctttccaagtttggagactagactgaaacttttttgggggagggggcaaaggggactttttacagtgatggaatgtaacattatatacatgtgtatataagacagtggacctttttatgacacataatcagaagagaaatccccctggctttggttggtttcgtaaatttagctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgtaacatagtttcagtgtgatttctagagctaattcaaaatagtattgatatattttatgtgactgcatttttggggaggggtaccgaaatcgttaaatttgtcagtttgcaaaaatatcaatctttaatgggagaattttcaatttgccaattttttccttgaatgggtttaagtatgctacaatatacagttcaggcaaaatttaagatgtaattatcttcaatacttaagtgtgcttgctttctagtgccttggttttctttcttgatgctggaaaaataaacaaaccggtattgagtgtttaggcgagtggaaagtggctacaatccaaaattttaaatttaactctgcctcggccattcaaaagtctaataacaaaaaatgtaaacctaatttggcagtttgttaggttagacaactgacagcctcatttcattcctacaagttggttttcagtaatctcttccttccccccagtaaggctggaagaggctcttggcaaacttcttagcgcaagcaatggttagattaatttgtgaggcagctctttaagacgttcagaggtaagaaatactggatttataaagcaaatggctgtttgggggattccaaggatttacctaattgtccaattctacgtgctctctataccaaaacaaaaaaaaagctatccacctttccatgtgggtcaaactaaaattagaaatgtcccctcactgcagatcaaatgtaaagcttccagttaaggagctaaatgaggtcctcagctgaatgaggaaccctgtacatccccttgcacagccctattctaaatcgcttaaactatgctgatagctgcttaggttcttgagtagttctgctcttaaacgtagggaggccctgagaactaaattttgccccaaaataaaaacagaaattatgagattgcctcctgtcattttggttaacccagtccttcacctgccctgtgtcagtgtcttctgagggcaattgcgttgctcaaatcactagcacagaggttccttaatttggggccttagaaaccattgtgggccttggggtccatgaaccccatgaaattatttgtagacttgtatgtacatttttctggggagaaggttcaagagattcataagattgtcaaactccttgaaggttcagaacctctgcagggaagggggaagaaaaccctcccattaggaagcatgcttttgcagttaaatggcgatggtggaggtgatagggacttcaagagtaaaatgcaccttgtattgcataagaagcatacacaaatcaataaatcaagggagattataccagtaggactgaatcagggccttcaaagctggactgagttggtcctgttctggcacatatggtccactggagacaatgtatgattgagcttttctttggtctaaaaattatattaaacatttattttgaaaaaaaaaaaaaaaaaaaaaaaaaaa

SEQ ID NO: 1287 - DNA, 3791 bp, Homo sapiens
acagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccacctctggaaaaagatcccccgcttgctcctcgctgaccccatcactgtgcaagctggggctgcaggaaggcagcaacaactcgtctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattgtggagtttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgaatcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacattcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatgcgtaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagaatgagaagatcctagaacagatagacaagagtggcgagctcataagccttagagaggaggtgacccaccttacccgctcacttcggcgtgcggagacagagaccaaagtgctccaggaggcctggcaggccagctggactccaactgccagcctatggccaccaattggatccaggagaaagtgtggctctctcaggaggtggacaaactgagagtgatgttcctggagatgaaaaatgagaaggaaaactcctgatcaagttccagagcccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatttgtttcacctctttttacctgcaatacccccttaccccaataccaagaccaactggcatagagccaactgagataaatgctatttaaataaagtgtatttaatgaaaaaaaaaaaaaaaaaaaaa

SEQ ID NO: 1288 - DNA, 2752 bp, Homo sapiens
agtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttctgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaagagctgaagatggatcgagtaaagcaggtttgtggtgattatttactgtctagaatggatgttaccagctgcatctcttaccgaaattttgcaagttgtatgggagactcccatttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggacatatgacttcaccaaggagcaatgctgggattgcaactgtagggaacaccatttatgcagtggaggattcgatggcaatgaatttctgaatacggcggaagtctataaccttgagtcaaatgaatggagcccctatacaaagattttccagttttaacgggtttaagaccctctcaaactaacaggcttagtgatgtaattatggttagcagaggtacacttgtgaataaagagggtgggtggggatagatgttgctaacagcaacacaaagcttttgcatattgcatactattaaacatgctgtacatactttttgggtttatttgggaaggaatgcaaagatgaaggtctgtttgtgtacttttaagactttggttattttactttttggaaaagataaaccaagaattgattgggcacatcaaaaaaaaaaaaaaaaaaaa

SEQ ID NO: 1289 - DNA, 2568 bp, Homo sapiens
gctgtcctgagcctgagtactctagctgccttgtcgccatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgctttctgctgccctgatcagcagtgcatctgccaggactgttgccaggagcacagtggccacaccatagtctccctggatgcagcccgcagggacaaggaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgcccttcttagaggagaaggagcaagctgcgctgaaccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaattttgcctgcaaattttcagaaccagtctatgctgccttctggctttccaagaaggaaagcgccatccggattgtagatctgggagaggaacccgagaagccagcaccgtccttggtggtgactgctccctagactccaggagccatatcccagacctttgccagctacagtgatgggatttgcattttagggtgatttgtgggcagaaataactgctgatggtagctggcttttgaaatcctatggggtctctgaatgaaaacattctccagctgctctcttttgctccatatggtgctgttctctatgtgtttgcagtaattcttttttttttttgagacggagtctcgcactgttgcccaggctggagagcagtggcgcgatctcggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccagggaccttaaagagtggctgaaaagattgcagagttatcataataaattgctaacttgcgt

SEQ ID NO: 1290 - DNA, 968 bp, Homo sapiens
gaattccgacaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcagaagcataatatctcctggatatcatgaagcaagatataagagaagaacaaaacaaaatccgtaattcattgaaagaattgtaatcatcaatctttcatattattaatactttgtaattattttctccccaacagtattttccagtagattctaatcatgtggtagggcagaaggaaatgtgttttttgttgttcatttgtttcttgtcaatagtcctgattattttagctttgctatactgacttatatctggaagtatataaccaagataagaaaataggttttaatatgatcatcttaagctaattgtaatgaaaagaactaatggactgtcaatattcagaaaaccaaaaataaaaaatacggaaaactaaaaaaaacccgaattc

SEQ ID NO: 1291 - DNA, 1347 bp, Homo sapiens
atggatcccaaatatttcatcttaattttgttttgtggacacctgaacaatacatttttttcaaagacagagacaattacaacagagaagcagtcacagcctaccttatacacatcatcaatgtcacaggtattggctaattctcaaaacacaacagggaatcctttgggtcaaccaacacaattcagcgacactttttctggacaatcaatatcacctgccaaagtcactgctggacaaccaacaccagctgtctatacctcttctgaaaaaccagaagcacatacttctgctggacaaccacttgcctacaacaccaaacaaccaacaccaatagccaacacctcctcccagcaagccgtgttcacctctgccagacaactaccatctgcccgtacttctaccacacaaccaccaaagtcatttgtctatacttttactcaacaatcatcatctgtccagatcccttctagaaaacaaataactgttcataatccatccacacaaccaacatcaactgtcaaaaattcacctaggagtacaccaggatttatcttagatactaccagtaacaaacaaaccccacaaaaaaacaattataattcaatagctgccatactaattggtgtacttctgacttctatgttggtagctataatcatcattgtactttggaaatgcttaaggaaaccagttttaaatgatcaaaattgggcaggtagatctccatttgctgatggagaaacccctgacatttgtatggataacatcagagaaaatgaaatatccacaaaacgtacatcaatcatttcacttacaccctggaaaccaagcaaaagcacacttttagcagatgacttagaaattaagttgtttgaatcaagtgaaaacattgaagactccaacaaccccaaaacagagaaaataaaagatcaagtaaatggtacatcagaagatagtgctgatggttcaacagttggaactgctgtttcttcttcagatgatgcagatctgcctccaccacctccccttctggatttggaaggacaggaaagtaaccaatctgacaaacccacaatgacaattgtatctcctcttccaaatgattctactagtctccctccatctctggactgtctcaatcaagactgtggagatcataaatctgagataatacaatcatttccaccgcttgactcacttaacttgcccctgccaccagtagattttatgaaaaaccaagaagattccaaccttgagatccagtgtcaggagttctctattcctcccaactctgatcaagatcttaatgaatccctgccacctccacctgcagaactgttataa

SEQ ID NO: 1292 - DNA, 3583 bp, Homo sapiens
acttgcgtctcgccctccggccaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcaggcctggaacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacagaccaggtgctggaaagggggcctgtgcttcagttgcatgacctgaaacgggaggcaggaggcggctatcgctgcgtggcgtctgtgcccagcatacccggcctgaaccgcacacagctggtcaagctggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagaccgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcacctgcacaccccctttcagagggccactgggttaggacctgaggacctcacttggccctgcaagccgcttttcagggaccagtccaccaccatctcctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcggcatccagaagcagctgcagtgttgctgccaccaccctcctgctcgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtacctgcggtgaggaagctgggcgctgttttcgagttcaggtgaattagcctcaatccccgtgttcacttgctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacggggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaaatcatacattgcttttttattctacatgggtaccacaggaacctgggggcctgtgaaactacaaccaaaaggcacacaaaaccgtttccagttggcagcagagatcaggggttacctctgcttctgagcaaatggctcaagctctaccagagcagacagctaccctacttttcagcagcaaaacgtcccgtatgacgcagcacgaagggcctggcaggctgttagcaggagctatgtcccttcctatcgtttccgtccactt

SEQ ID NO: 1293 - DNA, 2314 bp, Homo sapiens
ggaattcccgcccggcccggccccgcgccccgcagccccgggcgccgcgcgtcctgcccggcctgcggcccagcccttgcgccgctcgtccgacccgcgatcgtccaccagaccgtgcctcccggccgcccgggccccgcgtgcatgcttcggtctgggccagcctctgggccgtccgtccccactggccgggccatgccgagtcgccgcgtcgccagaccgccggctgcgccggagctgggggccttagggtcccccgacctctcctcactctcgctcgccgtttccaggagcacagatgaattggagatcatcgacgagtacatcaaggagaacggcttcggcctggacgggggacagccgggcccgggcgaggggctgccacgcctggtgtctcgcggggctgcgtccctgagcacggtcaccctgggccctgtggcgcccccagccacgccgccgccttggggctgccccctgggccgactagtgtccccagcgccgggcccgggcccgcagccgcacctggtcatcacggagcagcccaagcagcgcggcatgccgttccgctacgagtgcgagggccgctcggccggcagcatccttggggagagcagcaccgaggccagcaagacgctgcccgccatcgagctccgggattgtggagggctgcgggaggtggaggtgactgcctgcctggtgtggaaggactggcctcaccgagtccacccccacagcctcgtggggaaagactgcaccgacggcatctgcagggtgcggctccggcctcacgtcagcccccggcacagttttaacaacctgggcatccagtgtgtgaggaagaaggagattgaggctgccattgagcggaagattcaactgggcattgacccctacaacgctgggtccctgaagaaccatcaggaagtagacatgaatgtggtgaggatctgcttccaggcctcatatcgggaccagcagggacagatgcgccggatggatcctgtgctttccgagcccgtctatgacaagaaatccacaaacacatcagagctgcggatttgccgaattaacaaggaaagcgggccgtgcaccggtggcgaggagctctacttgctctgcgacaaggtgcagaaagaggacatatcagtggtgttcagcagggcctcctgggaaggtcgggctgacttctcccaggccgacgtgcaccgccagattgccattgtgttcaagacgccgccctacgaggacctggagattgtcgagcccgtgacagtcaacgtcttcctgcagcggctcaccgatggggtctgcagcgagccattgcctttcacgtacctgcctcgcgaccatgacagctacggcgtggacaagaaggcgaaacgggggatgcccgacgtccttggggagctgaacagctctgacccccatggcatcgagagcaaacggcggaagaaaaagccggccatcctggaccacttcctgcccaaccacggctcaggcccgttcctcccgccgtcagccctgctgccagaccctgacttcttctctggcaccgtgtccctgcccggcctggagccccctggcgggcctgacctcctggacgatggctttgcctacgaccctacggcccccacactcttcaccatgctggacctgctgcccccggcaccgccacacgctagcgctgttgtgtgcagcggaggtgccggggccgtggttggggagacccccggccctgaaccactgacactggactcgtaccaggccccgggccccggggatggaggcaccgccagccttgtgggcagcaacatgttccccaatcattaccgcgaggcggcctttgggggcggcctcctatccccggggcctgaagccacgtagccccgcgatgccagaggaggggcactgggtggggagggaggtggaggagccgtgcaatcccaaccaggatgtctagcacccccatccccttggcccttcctcatgcttctgaagtggacatattcagccttggcgagaagctccgttgcacgggtttccccttgagcccattttacagatgaggaaactgagtccggagaggaaaagggacatggctcccgtgcactagcttgttacagctgcctctgtccccacatgtgggggcaccttctccagtaggattcggaaaagattgtacatatgggaggagggggcagattcctggccctccctccccagacttgacttgaaggtggggggtaggttggttgttcagagtcttcccaataaagatgagtttttgagcctcaaaaaaaaaaaaaggaattcc

SEQ ID NO: 1294 - DNA, 2856 bp, Homo sapiens
tagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggctgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcctttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgataagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatcgcattattttgaatgtgaagggaa

SEQ ID NO: 1295 - DNA, 538 bp, Homo sapiens
agggagagagggaggggaggaaattggagaccccagcacccccttgctcactctcttgctcacagtccacgatggcccggtccctggtgtgccttggtgtcatcatcttgctgtctgccttctccggacctggtgtcaggggtggtcctatgcccaagctggctgaccggaagctgtgtgcggaccaggagtgcagccaccctatctccatggctgtggcccttcaggactacatggcccccgactgccgattcctgaccattcaccggggccaagtggtgtatgtcttctccaagctgaagggccgtgggcggctcttctggggaggcagcgttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttgggtttatgcaaatacaatcagcccagtgcaaac

SEQ ID NO: 1296 - DNA, 444 bp, Homo sapiens
aattctagaagtccaaatcactcattgtttgtgaaagctgagctcacagcaaaacaagccaccatgaagctgtcggtgtgtctcctgctggtcacgctggccctctgctgctaccaggccaatgccgagttctgcccagctcttgtttctgagctgttagacttcttcttcattagtgaacctctgttcaagttaagtcttgccaaatttgatgcccctccggaagctgttgcagccaagttaggagtgaagagatgcacggatcagatgtcccttcagaaacgaagcctcattgcggaagtcctggtgaaaatattgaagaaatgtagtgtgtgacatgtaaaaactttcatcctggtttccactgtctttcaatgacaccctgatcttcactgcagaatgtaaaggtttcaacgtcttgctttaataaatcacttgctctac

SEQ ID NO: 1297 - DNA, 1002 bp, Homo sapiens
ccgcgatctagaactagtcgaggcgtggcggccccatggccccgctgggaggcgccccgcggctggtactgctgttcagcggcaagaggaaatccgggaaggacttcgtgaccgaggcgctgcagagcagacttggagctgatgtctgtgctgtcctccggctctctggtccactcaaggaacagtatgctcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctggctggtgagtgacacacggagagtgtctgacatccagtggtttcgggaggcctatggggccgtgacgcagacggtccgcgttgtagcgttggagcagagccgacagcagcggggctgggtgttcacgccaggggtggacgatgctgagtcagaatgtggcctggacaacttcggggactttgactgggtcatcgagaaccatggagttgaacagcgcctggaggagcagttggagaacctgatagaatttatccgctccagactttagtcactaggttctaggagtgagctggggcctgctgaggtgggggtggggctgactctgcaaaatgggggtgtcccccgatcctggccgaggtgaggaacagacagggggggtctagattctgagggggttggtggatattgggcaaggcaggaaacctctggagacctcattttctccatggggaagacagccatgctcttcaggaggagactccaagggcaaaggagggtgtcttggctgtgcttgaaggcgaaaccctgccatatccccagtgccagtcccctcagcctgtggtggccttgcatcctgactggatgttctcagccccttgttctgggcaagaacccagagctccccagtgtggatactaataaacctcttggagcac

SEQ ID NO: 1298 - DNA, 1963 bp, Homo sapiens
gcgcggcgtgcaggtcgcagctgtggctcgggtgctggcaggtgctggcgggactggcggggatcgccgtggactgcctcaggggcgccgcagcccgctcggcccgagggcccgcctaaccgcgccgcccgcgcccgctcctcctcggcccgcgcccggagcgcgggggccgccggcgctgggtactcggcggccaccggggatcggggctgagcggtcggttcccgcccccgtgccgccgccgccgccttccggccgaccgcccggcttggccgctgctgccgcgtctggcccccgggtccccgccgctgggggcgcgggcggggtcgggggttgccgggcgccgccccccgtgcgcctggagtccacatcccgggcccggcggccggcgagcatggaggagaagtacctgcccgagctgatggcggagaaggactccctggacccctccttcacgcacgccctgcgcctggtgaaccaagaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaagaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaaaaaaaa

SEQ ID NO: 1299 - DNA, 1953 bp, Homo sapiens
gcagaccttgcttcatgagcaagctcatctctggaacaaactggcaaagcatctctgctggtgttcatcagaacagacaccatggcagagcatgattaccatgaagactatgggttcagcagtttcaatgacagcagccaggaggagcatcaagacttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaagagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttataggccttgccagggtttcgagaagctgctctggaatttgcaagtcatggctgtgccctcttgatgtggtgaggcaggctttgtttatagcttgcgcattctcatggagaagttatcagacactctggctggtttggaatgcttcttctcaggcatgaacatgtactgttctcttcttgaacactcatgctgaaagcccaagtagggggtctaaaatttttaaggactttccttcctccatctccaagaatgctgaaaccaagggggatgacatgtgactcctatgatctcaggttctccttgattgggactggggctgaaggttgaagaggtgagcacggccaacaaagctgttgatggtaggtggcacactgggtgcccaagctcagaaggctcttctgactactgggcaaagagtgtagatcagagcagcagtgaaaacaagtgctggcaccaccaggcacctcacagaaatgagatcaggctctgcctcaccttggggcttgacttttgtataggtagatgttcagattgctttgattaatccagaataactagcaccagggactatgaatgggcaaaactgaattataagaggctgataattccagtggtccatggaatgcttgaaaaatgtgcaaaacagcgtttaagactgtaatgaatctaagcagcatttctgaagtggactctttggtggctttgcattttaaaaatgaaattttccaatgtctgccacacaaacgtatgtaaatgtatatacccacacacatacacacatatgtcatatattactagcatatgagtttcatagctaagaaataaaactgttaaagtctccaaact

SEQ ID NO: 1300 - DNA, 858 bp, Homo sapiens
atggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcttggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtga

SEQ ID NO: 1301 - DNA, 576 bp, Homo sapiens
atggctactctgatctacgttgataaggaaattggagaaccaggcacccgtgtggctgccaaggatgtgctgaagctggagtctagaccttcaatcaaagcattagatgggatatctcaagttttaacaccacgttttggcaaaacatacgatgctccatcagccttacctaaagctaccagaaaggctttgggcactgtcaacagagctacagaaaagtcagtaaagaccaatggacccagaaaacaaaaacagccaagcttttctgccaaaaagatgaccgagaagactgttaaaacaaaaagttctgttcctgcctcagatgacgcctatccagaaatagaaaaattctttcccttcaatcttctagactttgagagttttgacctgcctgaagagcgccagattgcacacctccccttgagtggagtgcctctcatgatccttgatgaggagggagagcttgaaaagctgtttcagctgggccccccttcacctgtgaaaatgccctctccaccatgggaatgcaatctgtttgcagtctccttcaagcattctgtcgaccctggatgttga

SEQ ID NO: 1302 - DNA, 2972 bp, Homo sapiens
gcgcgcggctccgatgggaagcatgacccgggtggcgggacaagacttgcttcccggccacgcgcgctcggccggccgtggggcggggcataggcgtgacgtggtgtcgcgtatcgagtctccgcccccttcccgcctccccgtatataagacttcgccgagcactctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggarcttttgcggactatcacctaccagccagccgccagcaccaaaatgtgcgagcaggcgctgggcaagggttgcggaggggactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccytggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggagctccagccacctaccaccacagttgccaggtctggaacacccgcagtagaaaacaagcagcagattggggatgctattcggatgatagtcagagggactcttggcagctgtagcagcagcagtgaatgccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctctcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattacatggaggagaacctcatggatggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactgggtggaacccagaaccaggctaaggcatacagttcttgactttggacaatcccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcaaaaaaaaaaaaaaa

SEQ ID NO: 1303 - DNA, 2478 bp, Homo sapiens
cacctttccgcgggccgcggggatggcggcgcagggcgtagggcctgggccggggtcggcggcgcccccggggctggaggcggcccggcagaagctggcgctgcggcggaagaaggtgctgagcaccgaaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcaaactcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagagggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaaaaaaaaaaa

SEQ ID NO: 1304 - DNA, 2154 bp, Homo sapiens
atataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcgaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggaatcaacagtgagacaattatgaaaccagcttcaatttcagaggaagaattgttgaatttaatcaataaactgaataatgatgataatgtagatggcctccttgttcagttgcctcttccagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggcattccaaccctagggaagaatgtggttgtggctggaaggtcaaaaaacgttggaatgcccattgcaatgttactgcacacagatggggcgcatgaacgtcccggaggtgatgccactgttacaatatctcatcgatatactcccaaagagcagttgaagaaacatacaattcttgcagatattgtaatatctgctgcaggtattccaaatctgatcacagcagatatgatcaaggaaggagcagcagtcattgatgtgggaataaatagagttcacgatcctgtaactgccaaacccaagttggttggagatgtggattttgaaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccagaccttttgagttcaactgatcaaaccaaaggaaaagtgttgctagagaaaattggggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtatggta

SEQ ID NO: 1305 - DNA, 2053 bp, Homo sapiens
ccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccgtgctccctgccggcgccttcgcccgccggccgccgctggcggagctggccgcgctcaacctcagcggcagccgcctggacgaggtgcgcgcgggcgccttcgagcatctgcccagcctgcgccagctcgacctcagccacaacccactggccgacctcagtcccttcgctttctcgggcagcaatgccagcgtctcggcccccagtccccttgtggaactgatcctgaaccacatcgtgccccctgaagatgagcggcagaaccggagcttcgagggcatggtggtggcggccctgctggcgggccgtgcactgcaggggctccgccgcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacaaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgttaaaaaaaaaaaaaaataaagattcttaaaagaa

SEQ ID NO: 1306 - DNA, 817 bp, Homo sapiens
agtcctgcgtccgggccccgaggcgcagcagggcaccaggtggagcaccagctacgcgtggcgcagcgcagcgtccctagcaccgagcctcccgcagccgccgagatgctgcgaacagagagctgccgccccaggtcgcccgccggacaggtggccgcggcgtccccgctcctgctgctgctgctgctgctcgcctggtgcgcgggcgcctgccgaggtgctccaatattacctcaaggattacagcctgaacaacagctacagttgtggaatgagatagatgatacttgttcgtcttttctgtccattgattctcagcctcaggcatccaacgcactggaggagctttgctttatgattatgggaatgctaccaaagcctcaggaacaagatgaaaaagataatactaaaaggttcttatttcattattcgaagacacagaagttgggcaagtcaaatgttgtgtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaaaatggatgccagctaattttccacagagcaatgctatggaatacaaaatgtactgacattttgttttcttctgaaaaaaatccttgctaaatgtactctgttgaaaatccctgtgttgtcaatgttctcagttgtaacaatgttgtaaatgttcaatttgttgaaaattaaaaaatctaaaaataaa

SEQ ID NO: 1307 - DNA, 1496 bp, Homo sapiens
cgcactccctgctgggtgagcagcactgtaaagatgaagctggctaactggtactggctgagctcagctgttcttgccacttacggttttttggttgtggcaaacaatgaaacagaggaaattaaagatgaaagagcaaaggatgtctgcccagtgagactagaaagcagagggaaatgcgaagaggcaggggagtgcccctaccaggtaagcctgccccccttgactattcagctcccgaagcaattcagcaggatcgaggaggtgttcaaagaagtccaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttagagaattagagagtgaggttaacaagctgtcctctgagctaaagaatgccaaagaggagatcaatgtacttcatggtcgcctggagaagctgaatcttgtaaatatgaacaacatagaaaattatgttgacagcaaagtggcaaatctaacatttgttgtcaatagtttggatggcaaatgttcaaagtgtcccagccaagaacaaatacagtcacgtccagttcaacatctaatatataaagattgctctgactactacgcaataggcaaaagaagcagtgagacctacagagttacacctgatcccaaaaatagtagctttgaagtttactgtgacatggagaccatggggggaggctggacagtgctgcaggcacgtctcgatgggagcaccaacttcaccagaacatggcaagactacaaagcaggctttggaaacctcagaagggaattttggctggggaacgataaaattcatcttctgaccaagagtaaggaaatgattctgagaatagatcttgaagactttaatggtgtcgaactatatgccttgtatgatcagttttatgtggctaatgagtttctcaaatatcgtttacacgttggtaactataatggcacagctggagatgcattacgtttcaacaaacattacaaccacgatctgaagtttttcaccactccagataaagacaatgatcgatatccttctgggaactgtgggctgtactacagttcaggctggtggtttgatgcatgtctttctgcaaacttaaatggcaaatattatcaccaaaaatacagaggtgtccgtaatgggattttctggggtacctggcctggtgtaagtgaggcacaccctggtggctacaagtcctccttcaaagaggctaagatgatgatcagacccaagcactttaagccataaatcactctgttcattcctccaggtattcgttatctaatagggcaattaattccttcagcactttagaatatgccttgtttcatatttttcatagctaaaaaatgtttgacatcctttgagatattttattactaaaatctgcc

SEQ ID NO: 1308 - DNA, 3154 bp, Homo sapiens
cgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccacgctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 1309 - DNA, 2031 bp, Homo sapiens
ggcacgagggcgagctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacgttatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaactttaaaaaaaaaaaaaaaaaa

SEQ ID NO: 1310 - DNA, 1078 bp, Homo sapiens
cactcgctggtggtgggtgcgccgtgctgagctctggctgtcagtgtgttcgcccgcgtcccctccgcgctctccgcttgtggataactagctgctggttgatcgcactatgactctggaagaagtccgcggccaggacacagttccggaaagcacagccaggatgcagggtgccgggaaagcgctgcatgagttgctgctgtcggcgcagcgtcagggctgcctcactgccggcgtctacgagtcagccaaagtcttgaacgtggaccccgacaatgtgaccttctgtgtgctggctgcgggtgaggaggacgagggcgacatcgcgctgcagatccattttacgctgatccaggctttctgctgcgagaacgacatcgacatagtgcgcgtgggcgatgtgcagcggctggcggctatcgtgggcgccggcgaggaggcgggtgcgccgggcgacctgcactgcatcctcatttcgaaccccaacgaggacgcctggaaggatcccgccttggagaagctcagcctgttttgcgaggagagccgcagcgttaacgactgggtgcccagcatcaccctccccgagtgacagcccggcggggaccttggtctgatcgacgtggtgacgccccggggcgcctagagcgcggctggctctgtggaggggccctccgagggtgcccgagtgcggcgtggagactggcaggcggggggggcgcctggagagcgaggaggcgcggcctcccgaggaggggcccggtggcggcagggccaggctggtccgagctgaggactctgcaagtgtctggagcggctgctcgcccaggaaggcctaggctaggacgttggcctcagggccaggaaggacagactggccgggcaggcgtgactcagcagcctgcgctcggcaggaaggagcggcgccctggacttggtacagtttcaggagcgtgaaggacttaaccgactgccgctgctttttcaaaacggatccgggcaatgcttcgttttctaaaggatgctgctgttgaagctttgaattttacaataaactttttgaaacaaaaaaaaaaaaaaa

SEQ ID NO: 1311 - DNA, 2525 bp, Homo sapiens
ttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctggacgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggtgagggatgtgatgctggccaagcatgtcatcactctgcacgtgagtgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggacggggcccgtcagcacgagagggacagtgaccgcgtccagcatccccatcactgtgcggcagttggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgctcactggactcatggactcgccacgctcgccctccttgccgctgcctgccattgacaatgttgctgggacctctgcctccccactgcagccctcgaacttcccaggcaccctcctttctgccccagaggaaggagctgtagtgtcctgctgcctctgggcgcccgctctagcgggttctgggaagtgtgcttttggcatccgttaataataaagccacggtgtgttcaggt

SEQ ID NO: 1312 - DNA, 2665 bp, Homo sapiens
ggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgccgaacaactggtactacatttccccgaggctcaccttccagtgcctggaggacctggtgaaccactattctgaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctatccacatcatgaccaaaggaacccctccctggtgtctgatcagggctgtggcatcacaaaacattggatcatgacatgtcgggcgatgcttggaaaagcccagcatgtatgtatgcacacattgtgtgtgtgggaaggacaaagccactctcacaagaaagggcaccaggactgctctccaaggaactggacctgtccagacagttacactccaaggtcattggagagaacttctgtatgggcaagcctgagagggagaggaaacaaaagctgtgtcctggcagaaggtctgggtttgcagatgggtgccctgaatggaactactttaactaatccatagggacttctggtatgctttcctctctttttaaaggaacttcgtgacactaaacattagcccaaaggacttcttagccttcaattgggagatacctttggtctgctcctgcaccaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcaaacagaacttctctgggatgctgggattcttgcctgtatgaatgcatcaagtattcatttattgcccgaataggcattgcattaagtcctctgttaggtgtcaggcaagccaaaaaaaaaaaaaagatgctaagtcctaacccccaacagaagtgttcacagtgtagacgggaaaaaatgtataaacaaatgtgtaaaaagagaaatcagctcatggcttaggatggaattagagacaggtgagggacactcaggagctcattttccagctgctcttcagagtggaagggctggctggatcgggtaggtaagaatagctggattttttagaaaagaaatggatacagtctaaagaattaactcacccggtactttattctaagaagggtctggcatccatatgaggaaaaatgctcagctccaggaaagatggggagtccaagtggattaatgatgtcatgcataattttaagagacaagggagaaaacacaatgtatagccagagaaggagaagctcccatccaaatcctactaggaagagagtgggctgcagatgaatctgtgactcatgtttccctgtttcaaagggatcctggggaaggaggggaacatgcttgcagtatctctccctgtctgtctgctcacataagcattccgtccatctaagctcatcgtgctactggtatgtgtatgtgcagttacacagtttcctgtatcataaatcctagtgtgtttatacaaggagacatctgtggtttccccaaccgttccaaaaggctatttcaaaggaaccagcccacgtatgagaaatgaatgtaacactgtggacattgacttcccgcataaggcagggtgaccccctgaactccagatgtttgcacagtatcttatgtgttgttttccgttgtgacgaatgtgattggaacatttggggagcacccagagggatttttcagtgggaagcattacactttgctaaatcatgtatttattcctgattaaaacaaacctaataaatatttaacccttggc

SEQ ID NO: 1313 - DNA, 1832 bp, Homo sapiens
aggagaggaagagagacctgccctgtagcgtgactcctctagaaaaaaaaaaaaaaagccggagtattttactaagcccctaaaatgtcgagatttgtacaagatcttagcaaagcaatgtctcaagatggtgcttctcagttccaagaagtcattcggcaagagctagaattatctgtgaagaaggaactagaaaaaatactcaccacagcatcatcacatgaatttgagcacaccaaaaaagacctggatggatttcggaagctatttcatagatttttgcaagaaaaggggccttctgtggattggggaaaaatccagagaccccctgaagattcgattcaaccctatgaaaagataaaggccaggggcctgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaacatttgaacaaaacctacaatacagatgtccctcttgttttaatgaactcttttaacacggatgaagataccaaaaaaatactacagaagtacaatcattgtcgtgtgaaaatctacactttcaatcaaagcaggtacccgaggattaataaagaatctttacggcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatcaacccacccaatggaaaacgctgtgaatttgtcatggaagtcacaaataaaacacgtgcagatgtaaagggcgggacactcactcaatatgaaggcaaactgagactggtggaaattgctcaagtgccaaaagcacatgttgacgagttcaagtctgtatcaaagttcaaaatatttaatacaaacaacctatggatttctcttgcagcagttaaaagactgcaggagcaaaatgccattgacatggaaatcattgtgaatgcaaagactttggatggaggcctgaatgtcattcaattagaaactgcagtaggggctgccatcaaaagctttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggttcaagattatctaagaagatttgaaagtataccagatatgcttgaattggatcacctcacagtttcaggagatgtgacatttggaaaaaatgtttcattaaagggaacggttatcatcattgcaaatcatggtgacagaattgatatcccacctggagcagtattagagaacaagatagtgtctggaaaccttcgcatcttggaccactgaaatgaaaaatactgtggacacttaaataatgggctagtttcttacaatgaaatgttctctaggatttaggcactaaaaggtactttactatgttactgtaccctgcagtgttgatttttaaaatagagttttctgcagtatgcttttagtctaagaaaagcacagatggtgcaatactttccttctttgaagagatcccaaagttagttactcttaagtgc

SEQ ID NO: 1314 - DNA, 2232 bp, Homo sapiens
cttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcagtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcatagcagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcaacaacaagcttcaaggaattc

SEQ ID NO: 1315 - DNA, 2717 bp, Homo sapiens
cagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgagggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaaaaaaaa

SEQ ID NO: 1316 - DNA, 2126 bp, Homo sapiens
gctctgtcagtaacacatgtgtaagagccgcggagggagcgagcgagccggctagaggccagcgccgccgccgccgccgcctccgagccgggcagcaacagccccggcagcggcgcaggctccagcgcgccgggcccggccggccgcagcccccgacgcctgggtgcgcctgcctgccggcctccgcaccgtccgccgccgctcccggggctgttgtgtctgcgactgctcccggccggaggtgcagggagctcagccgagccgccgctgccatcccggagcgagcaagcgagcgagcgcgcgggagggaggaaggcggcggcggaggaggaggaggagcgggaggagcgcgggcgggggcgggggccgccgggcgggggaatatacaaagtgaagccacattgccaaacttgcagcagcgattgcagcagttgctgccgctgcgccgcgcctgaagccgcgccgcgcgggccgagggctcctgcagctgctcgcgcgcagtcggaggcggagaaggacgaagactgagactgacacttctgctcccggccgcccggcacttacgcgggggccccccaacccgccccagagcaacgcgatttaaaaaaaaaaaaaaagccgcccttagccccctcctctcctttcctgcttctgcgagaactccctccctccctccagctccgccagcccaggcgccccttccctggaagccgagcggcttcgctcgcatttcaccgccgccgcctctcgcaatattgcaatataggggaaaagcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggttatttggaaatagcggtgcttgcagcgcttgcggacagtcgattcctgcgagtgaactcgtcatgagggcgcaaggcaatgtgtatcatcttaagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaataaaaaaaaaaaaaaaaaaaaaaaaaaaaaaaaaaaaaaaaaaaaaaaaaaaaaaaaaaaaaaaa

SEQ ID NO: 1317 - DNA, 1712 bp, Homo sapiens
atgagaaataagaaaattctcaaggaggacgagctcttgagtgagacccaacaagctgcttttcaccaaattgcaatggagcctttcgaaatcaatgttccaaagcccaagaggagaaatggggtgaacttctccctagctgtggtggtcatctacctgatcctgctcaccgctggcgctgggctgctggtggtccaagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccagggatgttcagaatcaaaggtgaacaaggcgccccaggtcttcaaggtcacaagggggccatgggcatgcctggtgcccctggcccgccgggaccacctgctgagaagggagccaagggggctatgggacgagatggagcaacaggcccctcgggaccccaaggcccaccgggagtcaagggagaggcgggcctccaaggaccccagggtgctccagggaagcaaggagccactggcaccccaggaccccaaggagagaagggcagcaaaggcgatgggggtctcattggcccaaaaggggaaactggaactaagggagagaaaggagacctgggtctcccaggaagcaaaggggacaggggcatgaaaggagatgcaggggtcatggggcctcctggagcccaggggagtaaaggtgacttcgggaggccaggcccaccaggtttggctggttttcctggagctaaaggagatcaaggacaacctggactgcagggtgttccgggccctcctggtgcagtgggacacccaggtgccaagggtgagcctggcagtgctggctcccctgggcgagcaggacttccagggagccccgggagtccaggagccacaggcctgaaaggaagcaaaggggacacaggacttcaaggacagcaaggaagaaaaggagaatcaggagttccaggccctgcaggtgtgaagggagaacaggggagcccagggctggcaggtcccaagggagcccctggacaagctggccagaagggagaccagggagtgaaaggatcttctggggagcaaggagtaaagggagaaaaaggtgaaagaggtgaaaactcagtgtccgtcaggattgtcggcagtagtaaccgaggccgggctgaagtttactacagtggtacctgggggacaatttgcgatgacgagtggcaaaattctgatgccattgtcttctgccgcatgctgggttactccaaaggaagggccctgtacaaagtgggagctggcactgggcagatctggctggataatgttcagtgtcggggcacggagagtaccctgtggagctgcaccaagaatagctggggccatcatgactgcagccacgaggaggacgcaggcgtggagtgcagcgtctgacccggaaaccctttcacttctctgctcccgaggtgtcctcgggctcatatgtgggaaggcagaggatctctgaggagttccctggggacaactgagcagcctctggagaggggccattaataaagctcaacatcaaaaaaaccggaatt

SEQ ID NO: 1318 - DNA, 1327 bp, Homo sapiens
ggtcgacgacgtggcagccgggatgcactaggcaaagccagctgggctcctgagtccggtgggtacttggagaacttactacgtctagctggaggattgtaaatgtaccaatcagcatgctgtgtctagctcaagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactattttttaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctacctctactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcattcaaggaggtgaaaatgatggatgactcctccaagatgaaaatggaccagccgcagtgctcacgcctgtaataccagcactttgggaggctgaggcaggcggatcacttgaggtcaggagtttgaaactagcctggccaacgtggcaaaactccatctctattaaaaatacaaaaattagccaggcatagtggtgcatgcctgtagtcccagctacttgggatgccgaggcaggaagaattgcttgaacctgggaggcagagtctgcagtgagccgagatcatgccactgcactccagcctgggtgacagagccactccgtctcaaaaaaaaaaaaaaaaaaaaaaaaaaaaaaaa

SEQ ID NO: 1319 - DNA, 1982 bp, Homo sapiens
tagagaaggcagacgcatcccgaactcgctggaggacaaggctcagctcttgccaggccaaattgagacatgtctgacacaagcgagagtggtgcaggtctaactcgcttccaggctgaagcctcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattccttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctatccaacacagcactctaggcagccact

SEQ ID NO: 1320 - DNA, 1210 bp, Homo sapiens
gggcccgttgaggcggagctcagttcccggccaggacacggtctgggccgccgaatctccggccgaagagcggcggcggcagggcgggaaaaaaatgaagaatgaaattgctgccgttgtcttctttttcacaaggctagttcgaaaacatgataagttgaaaaaagaggcagttgagaggtttgctgagaaattgaccctaatacttcaaggaaaatataaaaacccttggtatccagaaaaaccatcgaaaggacaggcctacagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcggtatggagagaaaaacaatgcattcattgttgccagctttgaaaataaagatgagaacaaggatgagatctccaggaaagttaccagggcccttgataaggttacctctgattatcattcaggatcctcttcttcagatgaagaaacaagtaaggaaatggaagtgaaacccagttcggtgactgcagccgcaagtcctgtgtaccagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgccgaagtttttaatattggacttgagtatttatatattgtgcatcaactctgttggatacgagaacactgtagaagtggacgatttgttctagcacctttgagaatttactttatggagcgtatgtaagttatttatat

SEQ ID NO: 1321 - DNA, 2061 bp, Homo sapiens
tgttccgcgatcttctcaggctctcctagcagcatccatcgccgccaccctatcttcactggcttcaccttctccttctctcttcgttgctgagcgacaagcttcctagcgctatgactgtcgtctccgtcccgcagcgggagccgctcgtcctgggtggccgccttgcgccgcttggcttttcctcccgaggttactttggggccctcccgatggtgaccacggctccgcctcctttaccccggatcccggacccccgggcactgcccccgaccctcttcctccctcatttcctagggggagatggcccgtgtctgaccccccagcctcgcgctccagcagctctgcccaaccgcagcctcgccgtggcgggaggcactcctcgggcagcgccgaagaagcggcgaaagaagaaggtgcgggccagccccgcagggcagctgcccagccgcttccaccagtaccagcagcaccggccgagtctggagggcggccggagccccgcgaccggcccgagcggagcgcaggaggtcccgggcccggccgccgccttggccccgagtcctgcagccgcagccggcacggagggagccagccccgaccttgccccgctgcggcccgcggctcccggccaaacccccctcaggaaagaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaaccctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaaagtaagggagacaga

SEQ ID NO: 1322 - DNA, 2910 bp, Homo sapiens
gggggagcccctgcaagtttcccgggccgcgcgccgcgctcgctcgcctcccagcccgcggcccgagccgccgccgcgcccgccatgccctcggccaaacaaaggggctccaagggcggccacggcgccgcgagcccctcggagaagggtgcccacccgtcgggcggcgcggatgacgtggcgaagaagccgccgccggcgccgcagcagccgccgccgccgcccgcgccgcacccgcagcagcacccgcagcagcacccgcagaaccaggcgcacggcaagggcggccaccgcggcggcggcggcggcggcggcaagtcctcctcctcctcctccgcctccgccgccgctgccgccgccgccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcagccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggttcgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggcccctgcaggggccctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttacttttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgttctcttcctgacgcatctgtgatatcagaggtaactatgcaaagcatccaggcggttctgaatgtgaagcactacacccagcagagtcccggtgccctctgtccccactgccggcccatgtcctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaa

SEQ ID NO: 1323 - DNA, 1874 bp, Homo sapiens
ggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctacgacgacatggccacctgcatgaaggcagtgaccgagcagggcgccgagctgtccaacgaggagcgcaacctgctctccgtggcctacaagaacgtggtcgggggccgcaggtccgcctggagggtcatctctagcatcgagcagaagaccgacacctccgacaagaagttgcagctgattaaggactatcgggagaaagtggagtccgagctgagatccatctgcaccacggtgctggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaactaaatccatacagggtgtcatccttctttccttcaagaaacctttttacacatctccattccttattccacttggatttcctatagcaaagaaacccattcatgtgtatggaatcaactgtttatagtcttttcacactgcagctttgggaaaacttcattccttgatttgtgtttgtcttggccttcctggtgtgcagtactgctgtagaaaagtattaatagcttcatttcatataaacataagtaactcccaaacacttatgtagaggactaaaaatgtatctggtatttaagtaatctgaaccagttctgcaagtgactgtgttttgtattactgtgaaaataagaaaatgtagttaattacaatttaaagagtattccacataacttcttaatttctacattccctcccttactcttcgggggtttcctttcagtaagcaacttttccatgctcttaatgtattcctttttagtaggaatccggaagtattagattgaatggaaaagcacttgccatctctgtctaggggtcacaaattgaaatggctcctgtatcacatacggaggtcttgtgtatctgtggcaacagggagtttccttattcactctttatttgctgctgtttaagttgccaacctcccctcccaataaaaattcacttacacctcctgcctttgtagttctggtattcactttactatgtgatagaagtgcatgttgctgccagaatacaagcattgcttttggcaaattaaagtgcatgtcatttcttaatacactagaaaggggaaataaattaaagtacacaagtccaagtctaaaactttagtacttttccatgcagatttgtgcacatgtgagagggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccaaaaaaaaaaaaaaaaaaa

SEQ ID NO: 1324 - DNA, 419 bp, Homo sapiens
ctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggatcgggaaaaaattcggcctcctgaaatgacagcagggagacttgggtcggcctcctgaaatgatagcagggagacttgggtgaccccccttccaggcgccatctagcacagcctggccctgatctccgggcagccaccacctcctcggtctgccccctcattaaaattcacgttcccaccctgaaa

SEQ ID NO: 1325 - DNA, 912 bp, Homo sapiens
ggcacgagcgctcatggcgggcggaggagccggggaccccggcctgggggcggccgccgccccagcgcccgagacccgcgagcacctcttcaaggtgctggtgatcggcgagcttggcgtgggcaagaccagcatcatcaagcgctacgtccaccagctcttctcccagcactaccgggccaccatcggggtggacttcgccctcaaggtcctcaactgggacagcaggactctggtgcgcctgcagctgtgggacatcgcggggcaggagcgatttggcaacatgacccgagtatactacaaggaagctgttggtgcttttgtagtctttgatatatcaagaagttccacatttgaggcagtcttaaaatggaaaagtgatctggatagtaaagttcatcttccaaatggcagccctatccctgctgtcctcttggctaacaaatgtgaccagaacaaggacagtagccagagtccttcccaggtggaccaattctgcaaagaacatggctttgccggatggtttgaaacctctgcaaaggataacataaacatagaggaagctgcccggttcctagtggagaagattcttgtaaaccaccaaagctttcctaatgaagaaaacgatgtggacaaaattaagctagatcaagagaccttgagagcagagaacaaatcccagtgttgctgatatatggcttctgcttctcttgtgtgtgcctcagctctgaagaagttcctgagaatgggttacagatgtcatgttagctgggagtcttcccacatgtggcacttcaaaaggcagcaccactgggcgcctgcacttatttgaaaatggaactttgggagaagtatccctgctagtggctctgtaacttaacagatgacaattaggcttttgtcattgttgcc

SEQ ID NO: 1326 - DNA, 1260 bp, Homo sapiens
atgaagtttccagggcctttggaaaaccagagattgtctttcctgttggaaaaggcaatcactagggaagcacagatgtggaaagtgaatgtgcggaaaatgccttcaaatcagaatgtttctccatcccagagagatgaagtaattcaatggctggccaaactcaagtaccaattcaacctttacccagaaacatttgctctggctagcagtcttttggataggtttttagctaccgtaaaggctcatccaaaatacttgagttgtattgcaatcagctgttttttcctagctgccaagactgttgaggaagatgagagaattccagtactaaaggtattggcaagagacagtttctgtggatgttcctcatctgaaattttgagaatggagagaattattctggataagttgaattgggatcttcacacagccacaccattggattttcttcatattttccatgccattgcagtgtcaactaggcctcagttacttttcagtttgcccaaattgagcccatctcaacatttggcagtccttaccaagcaactacttcactgtatggcctgcaaccaacttctgcaattcagaggatccatgcttgctctggccatggttagtctggaaatggagaaactcattcctgattggctttctcttacaattgaactgcttcagaaagcacagatggatagctcccagttgatccattgtcgggagcttgtggcacatcacctttctactctgcagtcttccctgcctctgaattccgtttatgtctaccgtcccctcaagcacaccctggtgacctgtgacaaaggagtgttcagattacatccctcctctgtcccaggcccagacttctccaaggacaacagcaagccagaagtgccagtcagaggtacagcagccttttaccatcatctcccagctgccagtgggtgcaagcagacctctactaaacgcaaagtagaggaaatggaagtggatgacttctatgatggaatcaaacggctctataatgaagataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatccaaaatcaggaaaggctgtagaaggaaatataccttaacaggctgatttggagtgacccagaaaa

SEQ ID NO: 1327 - DNA, 2061 bp, Homo sapiens
tttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatc

SEQ ID NO: 1328 - DNA, 2825 bp, Homo sapiens
gcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgtggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgctcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcagacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttacgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagtcctagaggatccctactgttttctgttttatgtgtttatacattgtatgtaacaataaagagaaaaaataaaaaaaaaaaaaaaaaaaaaaaaaaaaaaaa

SEQ ID NO: 1329 - DNA, 1603 bp, Homo sapiens
tgagatgagagctgccgacagttgggggtcaagggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattca

SEQ ID NO: 1330 - DNA, 1061 bp, Homo sapiens
ctctgttttctcaaagctgaagtcggctaggtttgcaaagctgtgggctgagcactcaggcaatcacactctcagaaactgcggcggctctggactgcagcctcccaaggctccatgccagacaaagcatgcgtgtcacacttgctacaatagcctggatggtttcttttgtctccaattattcacacacagcaaatattttgccagatatcgaaaatgaagatttcatcaaagactgcgttcgaatccataacaagttccgatcagaggtgaaaccaacagccagtgatatgctatacatgacttgggacccagcactagcccaaattgcaaaagcatgggccagcaattgccagttttcacataatacacggctgaagccaccccacaagctgcacccaaacttcacttcactgggagagaacatctggactgggtctgtgcccattttttctgtgtcttccgccatcacaaactggtatgacgaaatccaggactatgacttcaagactcggatatgcaaaaaagtctgtggccactacactcaggttgtttgggcagatagttacaaagttggctgcgcagttcaattttgccctaaagtttctggctttgacgctctttccaatggagcacattttatatgcaactacggaccaggagggaattacccaacttggccatataagagaggagccacctgcagtgcctgccccaataatgacaagtgtttggacaatctctgtgttaaccgacagcgagaccaagtgaaacgttactactctgttgtatatccaggctggcccatatatccacgtaacagatacacttctctctttctcattgttaattcagtaattctaatactgtctgttataattaccattttggtacagctcaagtaccctaatttagttcttttggactaatacaattcaggaaagaaaaaacccaaaaaccaacctcattcacatatggcttttttttaaccaataacaattaggtgtacttctattttaaaacatttcagaaaaaaatatatgttatagcaatactcttac

SEQ ID NO: 1331 - DNA, 1705 bp, Homo sapiens
gggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccacctgcacaaagatggtgcctcactgcaacaagaaaccttaaggtgtcttaccgacgaaataaaaaacataaatgattgttctccaaggcctgagggcaagactcatgatgagcaagtcaaccccaatctggaacaatgtccctcctcttagaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaattttttcaaaccagtggctgatacctgccttgtacttagtaccttaataccaataacctaatggtacttaggcgagtaccatttgcacaatcactgttttacttatgagcagatacagatatatccaaacccttacctactaggtatcctgctagggttttcaattccaattcttgtattaagttttttcctttcagttttaggtgcgaaagtaatcagtcaatccaatatcccccatctttgtcttgaaacaaaaactgttttaagacgtctacgttgaattattcagagaattaagcaataaaagctcacacctta

SEQ ID NO: 1332 - DNA, 2170 bp, Homo sapiens
ctgagggctcatccctctgcagagcgcggggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccgactggataaagagggaagcccagagcccttggacagaaataacccactggaacccaagaacaaggccagattctccatcccatccatgacagagcaccatgcggggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccaggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaat

SEQ ID NO: 1333 - DNA, 921 bp, Homo sapiens
ccctcggacggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggcgtggtccacggtacttgaagaagccagagcccacatcctgtgcactgctgaaggaccctacgctcggtggcctggcacctcactttgagaagagtgagcacactggctttgcatcctggaaggcctgcagggggcggggcaggaaatgtacctgaaaaggattttagaaaaccctgggaaacccaccacaccaccacaaaatggcctttagtgtatgaaatgcacatggaggggatgtagttgcatttttgctaaaaaaaaaaaaaa

SEQ ID NO: 1334 - DNA, 2088 bp, Homo sapiens
gaattcggcacgagcgcgcggcgaatctcaacgctgcgccgtctgcgggcgcttccgggccaccagtttctctgctttccaccctggcgccccccagccctggctccccagctgcgctgccccgggcgtccacgccctgcgggcttagcgggttcagtgggctcaatctgcgcagcgccacctccatgttgaccaagcctctacaggggcctcccgcgccccccgggacccccacgccgccgccaggaggcaaggatcgggaagcgttcgaggccgagtatcgactcggccccctcctgggtaaggggggctttggcaccgtcttcgcaggacaccgcctcacagatcgactccaggtggccatcaaagtgattccccggaatcgtgtgctgggctggtcccccttgtcagactcagtcacatgcccactcgaagtcgcactgctatggaaagtgggtgcaggtggtgggcaccctggcgtgatccgcctgcttgactggtttgagacacaggaaggcttcatgctggtcctcgagcggcctttgcccgcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatgggacaagggtgtacagccccccagagtggatctctcgacaccagtaccatgcactcccggccactgtctggtcactgggcatcctcctctatgacatggtgtgtggggacattccctttgagagggaccaggagattctggaagctgagctccacttcccagcccatgtctccccagactgctgtgccctaatccgccggtgcctggcccccaaaccttcttcccgaccctcactggaagagatcctgctggacccctggatgcaaacaccagccgaggatgttacccctcaacccctccaaaggaggccctgcccctttggcctggtccttgctaccctaagcctggcctggcctggcctggcccccaatggtcagaagagccatcccatggccatgtcacagggatagatggacatttgttgacttggttttacaggtcattaccagtcattaaagtccagtattactaaggtaagggattgaggatcaggggttagaagacataaaccaagtttgcccagttcccttcccaatcctacaaaggagccttcctcccagaacctgtggtccctgattttggagggggaacttcttgcttctcattttgctaaggaagtttattttggtgaagttgttcccattttgagccccgggactcttattttgatgatgtgtcaccccacattggcacctcctactaccaccacacaaacttagttcatatgcttttacttgggcaagggtgctttccttccaataccccagtagcttttattttagtaaagggaccctttcccctagcctagggtcccatattgggtcaagctgcttacctgcctcagcccaggattttttattttgggggaggtaatgccctgttgttaccccaaggcttctttttttttttttttttttttgggtgaggggaccctactttgttatcccaagtgctcttattctggtgagaagaaccttaattccataatttgggaaggaatggaagatggacaccaccggacaccaccagacaataggatgggatggatggttttttgggggatgggctaggggaaataaggcttgctgtttgttttcctggggcgctccctccaattttgcagatttttgcaacctcctcctgagccgggattgtccaattactaaaatgtaaataatcacgtattgtggggaggggagttccaagtgtgccctccttttttttcctgcctggattatttaaaaagccatgtgtggaaacccactatttaataaaagtaatagaatcagaaaaaaaaaaaaaaaaaaa

SEQ ID NO: 1335 - DNA, 8588 bp, Homo sapiens
cgcggcccgagcgcctcttttcgggattaaaagcgccgccagctcccgccgccgccgccgtcgccagcagcgccgctgcagccgccgccgccggagaagcaaccgctgggcggtgagatccccctagacatgcggctcgggggcgggcagctggtgtcagaggagctgatgaacctgggcgagagcttcatccagaccaacgacccgtcgctgaagctcttccagtgcgccgtctgcaacaagttcacgacggacaacctggacatgctgggcctgcacatgaacgtggagcgcagcctgtcggaggacgagtggaaggcggtgatgggggactcataccagtgcaagctctgccgctacaacacccagctcaaggccaacttccagctgcactgcaagacagacaagcacgtgcagaagtaccagctggtggcccacatcaaggagggcggcaaggccaacgagtggaggctcaagtgtgtggccatcggcaaccccgtgcacctcaagtgcaacgcctgtgactactacaccaacagcctggagaagctgcggctgcacacggtcaactccaggcacgaggccagcctgaagttgtacaagcacctgcagcagcatgagagtggtgtagaaggtgagagctgctactaccactgcgttctgtgcaactactccaccaaggccaagctcaacctcatccagcatgtgcgctccatgaagcaccagcgaagcgagagcctgcgaaagctgcagcggctgcagaagggccttccagaggaggacgaggacctggggcagatcttcaccatccgcaggtgcccctccacggacccagaagaagccattgaagatgttgaaggacccagtgaaacagctgctgatccagaggagcttgctaaggaccaagagggcggagcatcgtccagccaagcagagaaggagctgacagattctcctgcaacctccaaacgcatctccttcccaggtagctcagagtctcccctctcttcgaagcgaccaaaaacagctgaggagatcaaaccggagcagatgtaccagtgtccctactgcaagtacagtaatgccgatgtcaaccggctccgggtgcatgccatgacgcagcactcggtgcaacccatgcttcgctgccccctgtgccaggacatgctcaacaacaagatccacctccagctgcacctcacccacctccacagcgtggcacctgactgcgtggagaagctcattatgacggtgaccacccctgagatggtgatgccaagcagcatgttcctcccagcagctgttccagatcgagatgggaattccaatttggaagaggcaggaaagcagcctgaaacctcagaggatctgggaaagaacatcttgccatccgcaagcacagagcaaagcggagatttgaaaccatcccctgctgacccaggctctgtgagagaagactcaggcttcatctgctggaagaaggggtgcaaccaggttttcaaaacttctgctgcccttcagacgcattttaatgaagtgcatgccaagaggcctcagctgccggtgtcagatcgccatgtgtacaagtaccgctgtaatcagtgtagcctggccttcaagaccattgaaaagttgcagctccattctcagtaccatgtgatcagagctgccaccatgtgctgtctttgtcagcgcagtttccgaactttccaggctctgaagaagcaccttgagacaagccacctggagctgagtgaggctgacatccaacagctttatggtggcctgctggccaatggggacctcctggcaatgggagaccccactctggctgaggaccataccataattgttgaggaagacaaggaggaagagagtgacttggaagataaacagagcccaacgggcagtgactctgggtcagtacaagaagactcgggctcagagccaaagagagctctgcctttcagaaaaggtcccaattttactatggaaaagttcctagacccttctcgcccttacaagtgtaccgtctgcaaggaatctttcactcaaaagaatatcctgctagtacactacaattctgtctcccacctgcataagttaaagagagcccttcaagaatcagcaaccggtcagccagaacccaccagcagcccagacaacaaaccttttaagtgtaacacttgtaatgtggcctacagccagagttccactctggagatccatatgaggtctgtgttacatcaaaccaaggcccgggcagccaagctggaggctgcaagtggcagcagcaatgggactgggaacagcagcagtatttccttgagctcctccacgccaagtcctgtgagcaccagtggcagtaacacctttaccacctccaatccaagcagtgctggcattgctccaagctctaacttactaagccaagtgcccactgagagtgtagggatgccacccctggggaatcctattggtgccaacattgcttccccttcagagcccaaagaggccaatcggaagaaactggcagatatgattgcatccaggcagcagcaacaacagcagcagcaacagcaacaacaacaacaacaacaacaacaacaagcacaaacgctggcccaggcccaggctcaagttcaagctcacctgcagcaggagctgcagcaacaggctgccctgatccagtctcagctgtttaaccccaccctccttcctcacttccccatgacaactgagaccctgctgcaactacagcagcagcagcacctcctcttccctttctacatccccagtgctgagttccagcttaaccccgaggtgagcttgccagtgaccagtggggcactgacactgactgggacaggcccaggcctgctggaagatctgaaggctcaggttcaggtcccacagcagagccatcagcagatcttgccgcagcagcagcagaaccaactctctatagcccagagtcactctgccctccttcagccaagccagcaccccgaaaagaagaacaaattggtcatcaaagaaaaggaaaaagaaagccagagagagagggacagcgccgaggggggagagggcaacaccggtccgaaggaaacactgccagatgccttgaaggccaaagagaagaaagagttggcaccagggggtggttctgagccttccatgctccctccacgcattgcttcagatgccagagggaacgccaccaaggccctgctggagaactttggctttgagttggtcatccagtataatgagaacaagcagaaggtgcagaaaaagaatgggaagactgaccagggagagaacctggaaaagctcgagtgtgactcctgcggcaagttgttttccaacatcttgattttaaagagtcatcaagagcacgttcatcagaattactttcctttcaaacagctcgagaggtttgccaaacagtacagagaccactacgataaactgtacccactgaggccccagaccccagagccaccaccacctccccctccaccccctccacccccacttccggcagcgccgcctcagccggcgtccacaccagccatccccgcatcagccccacccatcacctcacctacaattgcaccggcccagccatcagtgccgctcacccagctctccatgccgatggagctgcccatcttctcgccgctgatgatgcagacgatgccgctgcagaccttgccggctcagctacccccgcagctgggacctgtggagcctctgcctgcggacctggcccaactctaccagcatcagctcaatccaaccctgctccagcagcagaacaagaggcctcgcaccaggatcacagatgatcagctccgagtcttgcggcaatattttgacattaacaactcccccagtgaagagcaaataaaagagatggcagacaagtccgggttgccccagaaagtgatcaagcactggttcaggaacactctcttcaaagagaggcagcgtaacaaggactccccttacaacttcagtaatcctcctatcaccagcctggaggagctcaagattgactcccggcccccttcgccggaacctccaaagcaggagtactggggaagcaagaggtcttcaagaacaaggtttacggactaccagctgagggtcttacaggacttcttcgatgccaatgcttacccaaaggatgatgaatttgagcaactctctaatttactgaaccttccaacccgagtgatagtggtgtggtttcagaatgcccgacagaaggccaggaagaattatgagaatcagggagagggcaaagatggagagcggcgtgagcttacaaatgatagatacattcgaacaagcaacttgaactaccagtgcaaaaaatgtagcctggtgtttcagcgcatctttgatctcatcaagcaccagaagaagctgtgttacaaggatgaggatgaggaggggcaggacgacagccaaaatgaggattccatggatgccatggaaatcctgacgcctaccagctcatcctgcagtaccccgatgccctcacaggcttacagcgccccagcaccatcagccaataatacagcttcctccgctttcttgcagcttacagcggaggctgaggaactggccaccttcaattcaaaaacagaggcaggcgatgagaaaccaaagctggcggaagctcccagtgcacagccaaaccaaacccaagaaaagcaaggacaaccaaagccagagctgcagcagcaagagcagcccgagcagaagaccaacactccccagcagaagctcccccagctggtgtccctgccttcgttgccacagcctcctccacaagcgccccctccacagtgccccttaccccagtcgagccccagtccttcccagctctcccacctgcccctcaagcccctccacacatcaactcctcaacagctcgcaaacctacctcctcagctaatcccctaccagtgtgaccagtgtaagttggcatttccgtcatttgagcactggcaggagcatcagcagctccacttcctgagcgcgcagaaccagttcatccacccccagtttttggacaggtccctggatatgcctttcatgctctttgatcccagtaacccactcctggccagccagctgctctctggggccatacctcagattccagcaagctcagccacttctccttcaactccaacctccacaatgaacactctcaagaggaagctggaggaaaaggccagtgcaagccctggcgaaaacgacagtgggacaggaggagaagagcctcagagagacaagcgtttgagaacaaccatcacaccggaacaactagaaattctctaccagaagtatctactggattccaatccgactcgaaagatgttggatcacattgcacacgaggtgggcttgaagaaacgtgtggtacaagtctggtttcagaacacccgagctcgggaaaggaaaggacagttccgggctgtaggcccagcgcaggcccacaggagatgccctttttgcagagcgctcttcaaagccaagactgctcttgaggctcatatccggtcccgtcactggcatgaagccaagagagctggctacaacctaactctgtctgcgatgctcttagactgtgatgggggactccagatgaaaggagatatttttgacggaactagcttttcccacctacccccaagcagtagtgatggtcagggtgtccccctctcacctgtgagtaaaaccatggaattgtcacccagaactcttctaagcccttcctccattaaggtggaagggattgaagactttgaaagcccctccatgtcctcagttaatctaaactttgaccaaactaagctggacaacgatgactgttcctctgtcaacacagcaatcacagataccacaactggagacgagggcaacgcagataacgacagtgcaacgggaatagcaactgaaaccaaatcctcttctgcacccaacgaagggttgaccaaagcggccatgatggcaatgtctgagtatgaagatcggttgtcatctggtctggtcagcccggccccgagcttttatagcaaggaatatgacaatgaaggtacagtggactacagtgaaacctcaagccttgcagatccctgctccccgagtcctggtgcgagtggatctgcaggcaaatctggtgacagcggggatcggcctgggcagaaacgttttcgcactcaaatgaccaatctgcagctgaaggtcctcaagtcatgctttaatgactacaggacacccactatgctagaatgtgaggtcctgggcaatgacattggactgccaaagagagtcgttcaggtctggttccagaatgcccgggcaaaagaaaagaagtccaagttaagcatggccaagcattttggtataaaccaaacgagttatgagggacccaaaacagagtgcactttgtgtggcatcaagtacagcgctcggctgtctgtacgtgaccatatcttttcccaacagcatatctccaaagttaaagacaccattggaagccagctggacaaggagaaagaatactttgacccagccaccgtacgtcagttgatggctcaacaagagttggaccggattaaaaaggccaacgaggtccttggactggcagctcagcagcaagggatgtttgacaacacccctcttcaggcccttaaccttcctacagcatatccagcgctccagggcattcctcctgtgttgctcccgggcctcaacagcccctccttgccaggctttactccatccaacacagctttaacgtctcctaagccgaacttgatgggtctgcccagcacaactgttccttcccctggcctccccacttctggattaccaaataaaccgtcctcagcgtcgctgagctccccaaccccagcacaagccacgatggcgatgggccctcagcaacccccccagcagcagcagcagcagcagcaaccacaggtgcagcagcctcccccgccgccagcagcccagccgccacccacaccacagctcccactgcaacagcagcagcaacgcaaggacaaagacagtgagaaagtaaaggagaaggaaaaggcacacaaagggaaaggggaacccctgcctgtccccaagaaggagaaaggagaggcccccacggcaactgcagccacgatctcagccccgctgcccaccatggagtatgcggtagaccctgcacagctgcaggccctgcaggccgcgttgacttcggaccccacagcattgctcacaagccagttccttccttactttgtaccaggcttttctccttattatgctccccagatccctggcgccctgcagagcgggtacctgcagcctatgtatggcatggaaggcctgttcccctacagccctgcactgtcgcaggccctgatggggctgtccccaggctccctactgcagcagtaccagcaataccagcagagtctgcaggaggcaattcagcagcagcagcagcaaaaagtgcagcagcagcagcccaaagcaagccaaaccccagtcccccccggggctccttccccagacaaagaccctgccaaagaatcccccaaaccagaagaacagaaaaacaccccccgtgaggtgtcccccctcctgccgaaactccctgaagagccagaagcagaaagcaaaagtgcggactccctctacgaccccttcattgttccaaaggtgcagtacaagttggtctgccgcaagtgccaggcgggcttcagcgacgaggaggcagcgaggagccacctgaagtccctctgcttcttcggccagtctgtggtgaacctgcaagagatggtgcttcacgtccccaccggcggcggcggcggtggcagtggcggcggcggcggcggtggcggcggcggcggcggcggcggcggcggctcgtaccactgcctggcgtgcgagagcgcgctctgtggggaggaagctctgagtcaacatctcgagtcggccttgcacaaacacagaacaatcacgagagcagcaagaaacgccaaagagcaccctagtttattacctcactctgcctgcttccccgatcctagcaccgcatctacctcgcagtctgccgctcactcaaacgacagcccccctcccccgtcggccgccgccccctcctccgcttccccccacgcctccaggaagtcttggccgcaagtggtctcccgggcttcggcagcgaagcccccttcttttcctcctctctcctcatcttcaacggttacctcaagttcatgcagcacctcaggggttcagccctcgatgccaacagacgactattcggaggagtctgacacggatctcagccaaaagtccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaaccaaaaaac

SEQ ID NO: 1336 - DNA, 1424 bp, Homo sapiens
aggagccttaggaggtacggggagctcgcaaatactccttttggtttattcttaccaccttgcttctgtgttccttgggaatgctgctgtgcttatgcatctggtctctttttggagctacagtggacaggcatttgtgacagcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtattatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaataaaaaaaaaaaaaaaaaaaa

SEQ ID NO: 1337 - DNA, 4145 bp, Homo sapiens
ggccgcgaattcggcacgagccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagtggttaataagtcgaaggtgcgtcgtgcaggcagtaggaaattagaatcaaggaaatacgagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgctacatgtgtctcccgcagcgctgtcatggcgtcctgcggcgccggaaggactggaacgtgcgcctgcaggccttcttcaccagtgacacggggcttgaatacgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggcccgtgatagcatcaaagaatgataaactcgagctgcaggactgcttggaatacaataggatagccaagttaaagaaagtacagacaataaccaccaagtcgaactcgatcaaacaggggaaaaaccaacttttccctgttgtcatgaatggcaaagaagatgttttgtggtgcactgagctcgaaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactgggtactgctatgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaatttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctaaaaaaaaaaaaaaaaaa

SEQ ID NO: 1338 - DNA, 1037 bp, Homo sapiens
cgcgagtgaaggaagacgaatgcgtgacccgaccggctgtggtgttccagtccccactgaccagtaggagcagcagggcgtcggcttgtgaggtggcttttcctcggggcaacccaggaaggccccaagaggacaatggattctggaactcgcccagttggtagctgctgtagcagccccgctgggctctcacgggagtacaaactagtgatgctgggtgctggtggtgtagggaagagtgccatgaccatgcagttcatcagccaccgattcccagaagatcatgatcccaccattgaagatgcttataagatcaggatccgtattgatgatgagcctgccaatctggacattttggatacagctggacaggcagagtttacagccatgcgggaccagtatatgagggcaggagaagggtttatcatctgttactctatcacggatcgtcgaagtttccatgaagttcgtgagtttaaacagcttatttatcgagtccgacgtactgacgatacacctgtggttcttgtgggaaacaagtcagacctcaaacagctaagacaggtcaccaaggaagaaggattggccttggcccgagaattcagctgtcccttttttgagacatctgctgcataccgctactatattgatgatgttttccatgcccttgtacgggagatacgtaggaaagaaaaggaggcagtactggccatggagaaaaaatctaagcccaaaaacagtgtatggaagaggctaaaatcaccattccggaagaagaaagattcagtaacttgaagagaagatgtgaagtgtttatctgtgaactgcagtgctgtatcaaagcagtccagtaacctgcagtactgagtatggtgcttgctctttcacttaactgataagagggacatgcctactaggagtttttaatgatgtggtatttaaagtattgtctcttagttaagtatgatttattaacccagtggagcactgtctgcttttaaattgtcacattagaatttgttctaccaaaaaaaaaa

SEQ ID NO: 1339 - DNA, 2092 bp, Homo sapiens
ccacgcgtccggtgcggacgggcgcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagcccttcaggaaatggctgtaagaatgaaaaattattcaatggagagtttacaaagactgaatagattattgcccagttattcttaagtaaggacaaagaaggaaatatcatcgtatttcttttttttaataaggaaaaaataatctccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggccccaacttgtatttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgattgcccagataatatattaggcactactgattttttagttaaattgatgcactacacttttgatgtttgaagttacaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgtaaaaaaaaaaaaaaaggcggc

SEQ ID NO: 1340 - DNA, 1075 bp, Homo sapiens
gttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatga

SEQ ID NO: 1341 - DNA, 3915 bp, Homo sapiens
gtggggtggggtggggctgggggcttgtcgccctttcaggctccaccctttgcggagattataaatagtcatgatcccagcgagacccagagatgcctgtaatggtgagactttggatccttcctgaggacgtggagaaaactttctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataatttttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttccttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaatgcacatagctatcgagtgtgctttagcttgaaaaggtgaccttgcaacttcatgtcaactttctggctcctcaaacagtaggttggcagtaaggcagggtcccatttctcactgagaagattgtgaatatttccatatggattttctattgttactctggttctttgttttaaaataaaaattctgaatgtacacg

SEQ ID NO: 1342 - DNA, 2565 bp, Homo sapiens
cgactgagccccagactggaggagaggtccgaggaggtgggcgttggactctttgcgaggaccccggcggctggcccgggggaggcggccgaagcggcggcggcggcggccgggggcgacatggcggaggagcaggatctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcagaaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagaactgcagtcgggcaaggcagacccgaagcgggacgggcgttccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcttctcaccccttgcctcccagtggtatttgaataaagtatgtagctataaaaaaaaaaaaaaaaaa

SEQ ID NO: 1343 - DNA, 3131 bp, Homo sapiens
ccgcggcggagccagaggctgcaggaagagcccgcgggggcccggagggtgcgattcctcggcccccgcaaaacaatgtgtgttgtgagccaggacgcaacttgccggagcggcgggggcgcgccgagcccgcctgagaccgcgctgaccttctccccccgccgtccgttgggcccgagcgcccagctcctcgctccccagttcgcgggggccgggccgagccgcggggcggggccgcccctccgtcgccgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagcggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagccgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccggactactgcacccccgaggttaccgagatgatcgcgggggactggcgcccgtctagcatcgcagacctggttttcacctactgagcccaccgtcagcggggcgcgcacgcccccaaaccagctgtttacatacaggaatcaggtattggggcccctcggaggccgaggctggcaccccatctcccgcgcagcctcccccctcctggacgtgcccatcccccctcagatccagacatcccctcccccgcagacacaccccaaggcagtccaacccccaccccttccccgacacccaagcccctccccacgtcgccccctcctgcacagccaccagcagccagccccctccgatacacctcccgtcctctcctacagacctgcacccctccccccttttgcacacgcccctcctcgtggccggaggaccgccccctcctttgctccggaatctctcctccctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccacccagcggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcccaccggcccttcctgtcacccaggtccaccctcagtactcaagctgcagtatacagcgggaaaaactgaggcactttggtgctaggggtttgggactgaggcgtggagagcagatctgatggcaggaagactctcgcttttaaacatctgggtttggggagagacatcgacttggccagtgagactgagaatggattccgagtagtgatgggccgttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacacccgccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctttctatttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgcg

SEQ ID NO: 1344 - DNA, 934 bp, Homo sapiens
gagcgagcgcgctgcagcgcgcgcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggttatatacaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcagggctgtgctcaatgactggatgttccctatatgcaaacaaaatcacaacggaattctttgatcctctctttgttgagcaaaagtatgaattaggagccgctctgtttattggatgggcaggagcctcactgtgcataattggtggtgtcatattttgcttttcaatatctgacaacaacaaaacacccagatacacatacaacggggccacatctgtcatgtcttctcggacaaagtatcatggtggagaagattttaaaacaacaaacccttcaaaacagtttgataaaaatgcttatgtctaaaagagctcgctggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacatagttagttatatactaatcattttctgttgtggctttctataaaaaataaacagtttatttacagg

SEQ ID NO: 1345 - DNA, 1177 bp, Homo sapiens
ggaaaggaaggtttaaaataattaatttaaaatgtcactaagtatagactgatgactgtatagagatgtgaaatgtataattacacatggaagcaatatgttgctgtgttgttattaggtttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgcattgtgccagaaacattgtgttatcttttatgttgttgttgttgctgttaaactataatatgtgacttctttttttattattttttgtttgaatgctttaaaaatctttaagtctgtggactgctgatgtacagtgcctttgctgctatggatcaaatcaaagaccgtgtagatatactttattgtataagtagaaaattacttaatttcatactagaaatggatggatgctgcaagttgaaatggactgtccattgacgttcctaatgtggtagcagaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttct

SEQ ID NO: 1346 - DNA, 764 bp, Homo sapiens
atgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatgtggtag

SEQ ID NO: 1347 - DNA, 783 bp, Homo sapiens
ggcacgagcgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttaaaaaaaaaaaaaaaaaaa

SEQ ID NO: 1348 - DNA, 5255 bp, Homo sapiens
cgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgcgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacaggctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttttgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcgggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtat

SEQ ID NO: 1349 - DNA, 2019 bp, Homo sapiens
tgggtcacggctgcttcccaccagcaaagaccacgactggagagccgagccggaggcagctgggaaacatgaagagcgtcttgctgctgaccacgctcctcgtgcctgcacacctggtggccgcctggagcaataattatgcggtggactgccctcaacactgtgacagcagtgagtgcaaaagcagcccgcgctgcaagaggacagtgctcgacgactgtggctgctgccgagtgtgcgctgcagggcggggagaaacttgctaccgcacagtctcaggcatggatggcatgaagtgtggcccggggctgaggtgtcagccttctaatggggaggatccttttggtgaagagtttggtatctgcaaagactgtccctacggcaccttcgggatggattgcagagagacctgcaactgccagtcaggcatctgtgacagggggacgggaaaatgcctgaaattccccttcttccaatattcagtaaccaagtcttccaacagatttgtttctctcacggagcatgacatggcatctggagatggcaatattgtgagagaagaagttgtgaaagagaatgctgccgggtctcccgtaatgaggaaatggttaaatccacgctgatcccggctgtgatttctgagagaaggctctattttcgtgattgttcaacacacagccaacattttaggaactttctagatatagcataagtacatgtaatttttgaagatccaaattgtgatgcatggtggatccagaaaacaaaaagtaggatacttacaatccataacatccatatgactgaacacttgtatgtgtttgttaaatattcgaatgcatgtagatttgttaaatgtgtgtgtatagtaacactgaagaactaaaaatgcaatttaggtaatcttacatggagacaggtcaaccaaagagggagctaggcaaagctgaagaccgcagtgagtcaaattagttctttgactttgatgtacattaatgttgggatatggaatgaagacttaagagcaggagaagatggggagggggtgggagtgggaaataaaatatttagcccttccttggtaggtagcttctctagaatttaattgtgctttttttttttttttggctttgggaaaagtcaaaataaaacaaccagaaaacccctgaaggaagtaagatgtttgaagcttatggaaatttgagtaacaaacagctttgaactgagagcaatttcaaaaggctgctgatgtagttcccgggttacctgtatctgaaggacggttctggggcataggaaacacatacacttccataaatagctttaacgtatgccacctcagagataaatctaagaagtattttacccactggtggtttgtgtgtgtatgaaggtaaatatttatatatttttataaataaatgtgttagtgcaagtcatcttccctacccatatttatcatcctcttgaggaaagaaatctagtattatttgttgaaaatggttagaataaaaacctatgactctataaggttttcaaacatctgaggcatgataaatttattatccataattataggagtcactctggatttcaaaaaatgtcaaaaaatgagcaacagagggaccttatttaaacataagtgctgtgacttcggtgaattttcaatttaaggtatgaaaataagtttttaggaggtttgtaaaagaagaatcaattttcagcagaaaacatgtcaactttaaaatataggtggaattaggagtatatttgaaagaatcttagcacaaacaggactgttgtactagatgttcttaggaaatatctcagaagtattttatttgaagtgaagaacttatttaagaattatttcagtatttacctgtattttattcttgaagttggccaacagagttgtgaatgtgtgtggaaggcctttgaatgtaaagctgcataagctgttaggttttgttttaaaaggacatgtttattattgttcaataaaaaagaacaagatac

SEQ ID NO: 1350 - DNA, 1532 bp, Homo sapiens
taaagtgtttctttttttcttcttctttttagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctaaatcacatggtaatcgtccaagtacaactgtcagagttcaccgttcatctgcacagaatgttcacaatgacagagggaaagctgttcgttgtcgtgaaaagaaagaacagaataaaggaagagaggaaaagaacaaatcacctgctgcagtaacagaaccagagacaaataaatttgatagtaccggatatgataaagacttagtagaagctttggaaagagatataatttcccagaatcccaatgttcgatgggatgatatcgctgatttagtagaagctaaaaagttgcttaaggaagccgtagtgttaccaatgtggatgcccgaattctttaagggcattaggagaccatggaaaggagtactgatggtcggcccacctggcacggggaagacgctccttgctaaagcagtagctacagaatgcaagacaacattcttcaatgtctcttcatcaactttgacttccaaatacagaggagaatctgagaagcttgttcgtcttctgtttgaaatggctcgattttattctccagccaccatatttattgatgagatagactccatctgtagtcgccgagggacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatggaggatttcgagatggctttaaaaaaggtttctaagtcagtgtctgctgcagacattgaaagatacgagaaatggatatttgagtttggatcatgctaactcgagaagcc

SEQ ID NO: 1351 - DNA, 12680 bp, Homo sapiens
cctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccccaggtggctgttcctttgatgagcactacagcaactgtggttatagtgtggctctagggaccaatgggttcacctgggagcagattaacacaacggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccaggggctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgtcccaaaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaactcgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaactgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaggctcaaccaggagtaacattctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttgacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaatatggctgtgttaaaaaatctatacaataaagctgtgaccctg

SEQ ID NO: 1352 - DNA, 1658 bp, Homo sapiens
ggcacgagctcggctcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttaaaaaaaaaaaaaaaaaaa

SEQ ID NO: 1353 - DNA, 1070 bp, Homo sapiens
gcgattgctggggctgcagcgctgcctccgagaccgagagtgggtggagcgggtcttcctggaagggtgcgataaggccgggcgaggtgcctgggatgcttctccccttccgcgaggaagagatctaattgggtagggcgggtgtagactagcctgccgagccgcccgctggcacctgcagcctcctgggcgcccgcgggcccggcgagaaagttgttaaagggagcgaggtggttgttcctggggtccgaggcgcgcctctcacgccctgcccaacagaagccgcagtcccgtggggtctggagacgcagtttccttgttaatgacaataaatccctgctccccctgcctcagacatctacgcagcgaaatcgagcctggccttgagggtccacaccgcgaggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcacgaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtctgtcagcgatgactttatacatcaagggggtcttgttttgctagagagtttggggtttggtttgtggatttcattgtgatttataataaggcttattttcacagaataaaataaagcaaaacgagggaggattttattgggggagtgcagcccaaaaaa

SEQ ID NO: 1354 - DNA, 1837 bp, Homo sapiens
agaagagcgggctaagacgccggaggaggtggcggcggctgggagaggcgagggttctggccgattttagcatcgaaactaggagaaataagaatggctgtagaggaacttcagtctataataaagagatgtcaaatcctagaagagcaagactttaaagaagaggattttggcctatttcagttagctgggcaaagatgcatagaagaagggcacacagaccagctattagaaattattcaaaatgaaaagaataaggtcatcatcaagaatatgggctggaatctcgttggtcctgttgttcgatgccttttgtgtaaagataaagaggatagtaaaagaaaagtttattttttgatctttgatttattggtaaagttatgcaatccaaaggaattattgttgggtttgcttgaactgattgaagagccctctggaaaacagatatcccaaagtattcttcttttgcttcagccattacaaacagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattttgtttcaaaagcttgaaatgccctttgctgacagcacaattctttgaacagtctgaagaaggtggaaatgatcctttcaggtattttgcatcagaaataataggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaagcccattgtaccttttgcagtttaatatggggcacattgaagtctttttgcaaagaacagaagagtctgttatctccaaaggattggagctgctggagaatagtttattgagaatagaagacaatagtctactttaccagtacttagaaatcaagagttttcttactgtacctcagggcttagtgaaagtaatgacactttgccccattgagacactgaggaaaaagagtttagctatgcttcagctgtatattaacaagttggattcacaaggcaaatatacattatttagagaacacgtaacaacaaatggtttacaggaccacagttgatttcccttcttgatttggtactttttctcccagagggtgcagaaacagatttactgcaaaactcagataggattatggcttcattaaatttattgaggtatttggttatcaaagataatgaaaatgacaatcaaactggattatggacagaacttggaaatattgagaataatttcttaaagccacttcatataggacttaatatgtcaaaagcacattatgaaggcagaaattaaaaatagccaagaggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtacctc

SEQ ID NO: 1355 - DNA, 1659 bp, Homo sapiens
tcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccggatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggtaaaaaaaaaaaaaaaaaaaaaaaaaaaaaaaaaaaaaaaaaaaaaaaaaaagggggggggga

SEQ ID NO: 1356 - DNA, 1359 bp, Homo sapiens
agcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccggatagaagcggctacattgacgagcatgagctggatgcccttttgaaggatctgtacgagaaaaacaaaaaggaaatcaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaacgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaactt

SEQ ID NO: 1357 - DNA, 1440 bp, Homo sapiens
ggaattccgtagctattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctagtcccaagaagatattggtaagctattgaatttagatatgcacctctgataagcaaggattgtttcccgtagattagga

SEQ ID NO: 1358 - DNA, 2306 bp, Homo sapiens
agcggggggagtggggaggaggggggtcggccgccgcagccatggaggccaactggaccgcgttcctgttccaggcccatgaagcttcccatcaccaacagcaggcagcacagaacagcttgctgcccctcctgagctctgccgtggagccccctgatcagaaaccattgcttccaataccaataactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggcctgaccacttaagctgtcatgtaaaacatgtccattcaacagaaagacccttcaaatgccaaacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaacatgcatgagtgaagagaccagtaaccaaaagcagcagcagcagcagcagcagcaacaacaacaacaacaacatgtgacaagctggccagggaagcaagtagaaacactcagactgtgggaagaagctgttaaagcaaggaagaaagaagctgctaacctgtgccaaacctccacggctgctacgacacctgtgactctcactactccattcagtataacatcctctgtgtcgtctgagactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgacttttt

SEQ ID NO: 1359 - DNA, 1647 bp, Homo sapiens
ggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagaaaaaaaaaaaaaaaa

SEQ ID NO: 1360 - DNA, 3575 bp, Homo sapiens
aggcatcgaactgcggtagtacgggttacggaatcactgtcgatgccctagctggatcaatgtttcgatctgatacgccagcttggcacgaggctgcctcaggaagcttggcttccctcccatgggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccagaggtttaagaaccgccctctagaggcagccctccttgctagtctgggacttcccggtggagtgaggaacccagcaacacgctcctgacttcccttcccaaggactcgacctgagaaggacacagcagtctctgaatttcatgctctcctctttgatgtgaagaaaatgaaaagctgaacagttgtggaactgtggatagagttagacaataaggccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcaacagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccccaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcaggtggccttgttgctggcatcccggccaggtgggcggggattaacaaagacagctgtttagggtcttctcccttaacccatgctttcataaaccccttcggacagcttccccgtccaggctttctaaccacacctacccagggtgccgcattcctgcactcagaagtctgcagggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaaaaaaaaaaaaaaaaaaaaa

SEQ ID NO: 1361 - DNA, 1007 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctc

SEQ ID NO: 1362 - DNA, 5210 bp, Homo sapiens
ccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctggagtcgggtgggagaatgtgctgctaaaggaaggtgagtcagcctcgaacgccacagaaacatccggcccagacatgactatcaagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacaaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagaagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgttggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgctcagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggactttgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcctgcagcctgacttagcccctgaagaggctgccggaacccagcggcccaagaatctgatgcagaccctcatggaagactatgagacacacaaatctaaaaggcgcgagagaatggatgatagtagttacacttctaagttactgtcttgcaaggtgacttccgaggtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatacaatgatgaaaatgaaacgaaaaggaagtccccccatcagactctggacacccaggaatcaaaagagaaaggacttttttggtgactcaatcccagtgtctggtttggggccaatctacaatggatccaaaaggacaaaacatgttacaagcaaatcaacatagttgctgcaggcggaactgagaccagcctctctgggcgatgaaggacaatggtggtagggccacttagagagcagtagggcccaggctggtgcagcctacatggcacaggatatttccctgcaccagtttcccacctgtcacttgcagcatcagagggtgttgcattaactccattttctccagcagccataaaatgaatggcgtttctctccatatttgcccagaagaggcagttatgattccacttctcctacatttaattatttttaattgagaacaactcatgatcacaattcataaaatccatattttaagacaatagttcttcatgtcacaaacacaatctattctacatgaggaggctgagaaaggggaagagaaaaacaaaccaaatggatgatgttagctttaggatcgtgtctgcttataatattcactgatctgcagtttatgagaacacattttcacagttatgtttcttcataggaaaactatatttagtgggcaacaactatttttatgatgggatgggggagtatatacacgtatagaatctgtacgcgttgaacaacttggttcaagatggtgggggcatttttagagcggcaataattgaaaaaaaaggcgaactctgccttggagaggtagatgataagaaataaaaaggtgtttataactattttgtattataaagtgggccttagagataggaagaagaatgatggattccttttggatcaatcagaaaggaaacacgaaagaaaagtcaggaaggtagagagagaaaaagggagggaaggagaaagaatgggaataaaataaggaggtaagagatactatttttgctgagcaaccagtgtgtttcaggatgatacaaagaaaaatatagaatagaaataagtgcaggcttggaatcagctacaaatcctaaagatggggtgtgtgtggatgtgtgtgtgtgtgtgtgtacaccattgtgtgtttgtaaaatgtgtatgttcatgagtaagggtgtgtgtgtgtgtgtattaaaattccagagtgaccgtggcacttgggtgtacaggtaattcctccagagctgtttgctggcttcaggagtggagtgagaatttcttttttatgaaaagggatataaaggcaccgagctgatgcagtatttgtaatattaagttgacctaacaaggtatttgcatgagtcacaattacaaagttttgagcggttttgtaatttgacatttaggaaagtctcctatttattctcatactttacattcatgcttagtatactatagaggatgccagctttaatctttctgtcatttaaagcaatatgataagggtattcaataattgggtgccctaaatttctggatgagaaaattttcaattctggccag

SEQ ID NO: 1363 - DNA, 3353 bp, Homo sapiens
tccaagctacgccactcgggctggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccgagcaaattcgattaaagaatatcagaaaagtatatggaaggtgtatgtggtatcgtttacggttattaaaaccccagccaaatattattcctacagtaaagaaaatagttctgcttgcaggatgggcattgttcttattccttgcatataaagtttccaaaacagaccgagaataccaagaatacaatccttatgaagtattaaatttggatcctggagccacagtagcagaaattaaaaaacaatatcgtttgctgtcacttaaatatcatccagataaaggaggtgatgaggttatgttcatgaggatagcaaaagcttatgctgctttaacggatgaagagtcccggaaaaattgggaagaatttggaaatccagatgggcctcaagccacaagctttggaattgccctgccagcttggatagttgaccagaaaaattcaattctggttttacttgtatatggattggcatttatggttatccttccagttgttgtgggctcttggtggtatcgctcaatacgctatagtggagaccagattctaatacgcacaacacagatttatacatactttgtttataaaacccgaaatatggatatgaaacgtcttatcatggttttggctggagcttctgaatttgatcctcagtataataaagatgccacaagcagaccaacggataatattctaataccacagctaatcagagaaattggcagcattaatttaaagaagaatgagcctccacttacctgcccatatagcctgaaggccagagttcttttactgtctcatcttgctagaatgaaaattcctgagacccttgaagaagatcagcaattcatgctaaaaaagtgtcctgccctacttcaagaaatggttaatgtaatctgccaactaatagtaatggcccggaaccgtgaagaaagggagtttcgtgctccaactttggcatccctagaaaactgcatgaagctttctcagatggccgttcagggacttcagcaatttaagtctccccttctgcagctccctcatattgaagaggacaatcttagacgggtttctaatcataagaagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacaggtgttagatgatgaagatagcaacaacatcacagtaggatccttagttacagtgttggttaagttgacaaggcaaacaatggctgaagtatttgaaaaggagcagtccatctgtgctgcagaggaacagccagcagaagatgggcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagagtggcaagaattacaacaaagcatacagcgaaaagagagagctctattggaaaccaaatcaaaaataacacatcctgtgtatagcctttactttcctgaggaaaaacaagaatggtggtggctttacattgcagataggaaggagcagacattaatatccatgccatatcatgtgtgtacgctgaaagatacagaggaggtagagctgaagtttcctgcaccaggcaagcctggaaattatcagtatactgtgtttctgagatcagactcctatatgggtttggatcagattaaaccattgaagttggaagttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttgaaagtgtatcataaaccagaacagtacagaactgatgttgaggaaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgtaaaaaaaaaaaaaaaagaactcgagggggggaacg

SEQ ID NO: 1364 - DNA, 1218 bp, Homo sapiens
tgcaaggtgggaagtgaagtcagtgcctcagttgctgatcagtgtgttttttgtgtccaattcttttatcaccaaaaaagggaagaaatattgcagtgaatgaagattcctctgcattttagcactgctttttcaactgtagttggcttttgaatgaggatgacaatggaagagatgaagaatgaagctgagaccacatccatggtttctatgcccctctatgcagtcatgtatcctgtgtttaatgagctagaacgagtaaatctgtctgcagcccagacactgagagccgctttcatcaaggctgaaaaagaaaatccaggtctcacacaagacatcattatgaaaattttagagaaaaaaagcgtggaagttaacttcacggagtcccttcttcgtatggcagctgatgatgtagaagagtatatgattgaacgaccagagccagaattccaagccctaaacgaaaaggcacgagcacttaaacaaattctcagtaagatcccagatgagatcaatgacagagtgaggtttctgcagacaatcaaggatatagctagtgcaataaaagaacttcttgatacagtgaataatgtcttcaagaaatatcaataccagaaccgcagggcacttgaacaccaaaagaaagaatttgtaaagtactccaaaagtttcagtgatactctgaaaacgtattttaaagatggcaaggcaataaatgtgttcgtaagtgccaaccgactaattcatcaaaccaacttaatacttcagaccttcaaaactgtggcctgaaagttgtatattgttaagagatgtacttctcagtggcagtattgaactgcctttatctgtaaattttaaagtttgactgtataaattatcagtccctcctgaagggatctaatccagaatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatccgaaaaaaaaaaaaaaaaaaaaacctgccc

SEQ ID NO: 1365 - DNA, 4520 bp, Homo sapiens
taggaacaggggagagtgcacctgctaccagtcaagctcagccagactgcaagaggaggcgaggcggagccagccgagggagtgaaccatggacaagttgaaatgcccgagtttcttcaagtgcagggagaaggagaaagtgtcggcttcatcagagaatttccatgttggtgaaaatgatgagaatcaggaccgtggtaactggtccaaaaaatcggattatcttctatctatgattggatacgcagtgggattaggaaatgtgtggagatttccatatctgacctacagcaatggtggaggcgccttcttgataccttatgcaattatgttagcattggctggtttacctttgttctttctggagtgttcactgggacaatttgctagcttaggtccagtttcagtttggaggattcttccattgtttcaaggtgtgggaattacaatggtcctgatctccatttttgtgacaatctattacaatgtcataattgcctatagtctttactacatgtttgcttcttttcaaagtgaactaccatggaaaaattgttcttcgtggtcagataaaaactgtagcagatcaccaatagtaactcactgtaatgtgagtacagtgaataaaggaatacaagagatcatccaaatgaataaaagctgggtagacatcaacaattttacctgcatcaacggcagtgaaatttatcagccagggcagcttcccagtgaacaatattggaataaagtggcgctccaacggtcaagtggaatgaatgagactggagtaattgtttggtatttagcactttgtcttcttctggcttggctcatagttggagcagcactatttaaaggaatcaaatcgtctggcaaggtggtatattttacagctcttttcccctatgtggtcctactcatcctgttagtacgaggtgcaactctggagggtgcttcaaaaggcatttcatactatattggagcccagtcaaattttacaaaacttaaggaagctgaggtatggaaagatgctgccactcagatattttactccctttcagtggcttggggtggcttagttgctctatcatcttacaataagttcaaaaacaactgcttctctgatgccattgtggtttgtttgacaaactgtctcactagcgtgtttgctggatttgctattttttctatattgggacacatggcccatatatctggaaaggaagtttctcaagttgtaaaatcaggttttgatttggcattcattgcctatccagaggctctagcccaactcccaggtggtccattttggtccatattattttttttcatgcttttaactttgggtctcgattctcagtttgcttcgattgaaacgatcacaacaacaattcaagatttatttcccaaagtgatgaagaaaatgagggttcccataactttgggctgctgcttggttttgtttctccttggtctcgtctgtgtgactcaggctggaatttactgggttcatctgattgaccacttctgtgctggatggggcattttaattgcagctatactggagctagttggaatcatctggatttatggagggaacagattcattgaggatacagaaatgatgattggagcaaagaggtggatattctggctatggtggagagcttgctggtttgtaattacgcctatccttttgattgcaatatttatctggtcattggtgcaatttcatagacctaattatggcgcaattccataccctgactggggagttgctttaggctggtgtatgattgttttctgcattatttggataccaattatggctatcataaaaataattcaggctaaaggaaacatctttcaacgccttataagttgctgcagaccagcttctaactggggtccatacctggaacaacatcgtggggaaagatataaagacatggtagatcctaaaaaagaggctgaccatgaaatacctactgttagtggcagcagaaaaccggaatgagatctcattgaaaaaaatatatgattgtataatgtgattttttttagaatagggggaaccttatttatttgtgtgttaactgaataggaaaatgtacatactatgttcatgatagtgtgatttttttcacatttaagcaggaatgcaatataaaaatgtgaatctcttaattctcagccatgtgcttattatatttctttttagattgtctatctgtataacacacacacacacacctaagagtctctatttcacaattatatttttgtaaatagtatatgcatttttaatacattggaggctttattttgaactaatttcttagagaatagttatattttctattacacaagtttaaaaatattattaacttgtattttcttaatatacaatctatcttttccacaaatatgagtgggaaataaatcagcacatttgaaagaaagtgttaaaactgaaggcctcacttaattagaaacgtgataaatatatggacaaatggactatacatactataagaggactgtagtttaatactttttacccaaatatgtttaaaaacatcgtgcatttgttacagctcatgttttctatatgaacttagtcattaatgttctttataaaaagtgaaataagatggaaaaattaggatcctacagccagtacgtgataaatctagaaaattgagttttgagtacctcttttcccatatacaatcttccttccttaggtaatttggaagaaaactatgacccatttaatttctattgtgtttcaccaaattcagtgttgttcattatacctctctgaaatataggtttaatttcaaatagaatatggacttaaatgttaatgagaaactggctttaatcaattctagcattttattactgtaatacagggctgatagagtgattttgtcttatatgagtcagttactacttacaggtgataacttgcatactattggaagataaagttgtcaaacttgtcaagaatgagaaaagccaaattagaaaatcctatgtcctagtttccttaccaaggataattaaatatatcactaagagctttatatattgattatatattgttgacaactggtttaagcatcatagcctatgatgataaacactgcctatatatgtaaatagcttttcatcaattcttaaatttcttaacctaggcttcagggagcatatgaaaccaaaattatatggaacattttctgtgtgtacatgtacatgcatttttctagggagagagtccgtaggtttatcagaatatcaaggaaaactgtgacccaaagaagtttaagaatcacatacagtgctgctggctttttgtgcttggcaaatgagtgacaatagaagaaataatttttcttacacattttaaaacgttttctcttccttgtgattgaagatgaaaggagtaagaaattaaggcatttgtttaatttatactggtaacttatttaggggggaggggacatgaaggtaggtaaataggtaggcctctaattgaaccacctctctaagttatgtacgtatatataagctgaaattgtgtttgacattctgagggttttctttttctttttcctttttttttttttttggtggggggctgggggtcagagtcttgttctgttgcctgggctggagtgcagtggcatgatctcagctcactgcaacctctgccttctggattcaagtgattctcctgcctcagcctcttgagtagctgggactacaggtgcccgccaccacaccagctaatttttgtatttttagtagaggcgaagtttccccatgttggccaggctggtcttgaactcccgacctcaagtgatctgtctacctcggcctcctaaagtgctgagattacaggtgtgagccaccgtgcccggcccattctaagggttttctttgaagacaggtcaaatgctgttagtaagtttcaggagattgttaattcctcagttataccagattttataaaatatttgagaatagatggctaacaagaggttagaaatacttttccttaattttaatccacagtatgttacatgcattctaccactacattttggtgctatttaaggtgtgcaattttctataggtgacttttgcaattcagggaagatttgggcatattaaatgaaagaatatctaattgggggaggtgtgaagggaaagaaattcttttcaaaagctgaccacaaagagtagttaaaagtttttgtcactatcttcacaagtgtgtaaagcacagatttcaacagagtgcttggcatattgtagggtgctcaatggtggtttttattattattactcagattccacagtggcaagaaacatcattctacataatggaaaacatttacatcaaatcccacttactttaatgcgaacttggagataatttatggtattgtattgtaaaccattaatgaaaactttttcacagttgagtgaaattaaaatcactatatctc

SEQ ID NO: 1366 - DNA, 2970 bp, Homo sapiens
ggcggatggaacgcggctcggcgggcgggcagtgccggcgtccgcggctgggaatggtgctggctgtgttggtcggtgcctgcgttctgaagcccgagaggagccacaatggagacgccgccgctgcctcccgcatgcacaaagcagggtcatcagaagcctctcgattcaaaagatgataataccgaaaaacactgcccagtgacagtgaatccttggcatatgaagaaagctttcaaagtcatgaacgaattaagaagtcaaaatttgctgtgcgatgtcacaattgtggcagaagacatggaaatttctgctcatagagtggtgctggccgcctgtagtccttattttcatgccatgtttacaggtgagatgagtgagagccgagcaaagagagttagaataaaagaggtagatggctggaccctgaggatgctaattgattatgtttacactgcagaaattcaggttacagaagaaaatgtacaggtacttctcccagcagctggtctcttacagttacaggatgtgaagaagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaaaattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccaggaggtgcagagcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtatcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgaccccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctggtgtaacacacttgaatatgtgtgatgccaaactttttaaaatacaatataaattatgcttatttattattttctttagtttaatcttggtcatgttttggtgtgtatttttaattttttcttaaattaacactttggcatgaacattactgcaggtttttgatgaatataatgaatgtatggaattcaattgaatttgcatggtcttcggaattttttctgtgtgtataaatttagctgctattaacagaagagagaactttctgtgagtagccatgtgtgttgatcagatacagtttttctgagatcttcaattaatctcactttaaaaatgaccaaaacatgtctttcttgaattaactttgaataaaagtttgt

SEQ ID NO: 1367 - DNA, 1787 bp, Homo sapiens
ggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaaaaaaaaaaaaaaaaaaa

SEQ ID NO: 1368 - DNA, 1492 bp, Homo sapiens
tttttttttccagccaagcagcagctttattagtggtgctgggttcttcccataccctacagcgtgctcggaagcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggcagccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgacgatcagggccacgcggacgctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggaaa

SEQ ID NO: 1369 - DNA, 1691 bp, Homo sapiens
tgcggccgcgtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggctctatgttctatgatgaggatggggatctggctcacgagttctatgaggagacaatcgtcaccaagaacgggcagaagcgggccaagctgaggcgagtgcataagaatctgattcctcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcatagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgc

SEQ ID NO: 1370 - DNA, 907 bp, Homo sapiens
cttttcttaagggaaaaatcacgctgtgttcttttaaaatccctcaggttttatgttttattgctaccagagtctgcctccctgaggttcttgtatagactagttatttccctctgtaaagaagctgttctattcgttctcgcctggtttggaacaaactgaacacttccaaaggaggcagtccttgcagccttgtctccttccactcccctcctccccacagtcctggctggagcagcgagtctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaatttttctctgtggaaaaa

SEQ ID NO: 1371 - DNA, 3753 bp, Homo sapiens
gcggggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagtggtaaatcatccctgtgcaacaagggctaatccaagatcagctacataaacggcctgagtgctgttttaaacaggattgggttgatggtacaacatgactttttaagataatcaagttagttaaaagtttcctagttggaaaactttgaaaaaaaaaaaaa

SEQ ID NO: 1372 - DNA, 4003 bp, Homo sapiens
attaaacctctcgccgagcccctccgcagactctgcgccggaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatcgacacagtgctttccgtggcactgcatacaatctgaggcctcctctctcagtttttatatagatggcgagaacctaagtttcagttgattttacaattgaaatgactaaaaaacaaagaagacaacattaaaaacaatattgtttcta

SEQ ID NO: 1373 - DNA, 1271 bp, Homo sapiens
ctgtattgtggttcctggaacactttagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcagcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacctacatttgagaattataaaattaacataaagaattttgtattttcatttaatgtatataatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaa

SEQ ID NO: 1374 - DNA, 2648 bp, Homo sapiens
caccgcgggaaaccaaaatggcgaggggctgtattgaagtgggctgtgtttgaggccggtgtaagaacgctcattctacccccaacccttgtctccaaggacctcggtttgtgcgtgcatatgtgccgggtacccggtggggcgggtgcccagtaagtgctcggactcgcaggggaagcgcccacggggacggattggttgttttttcctgtatgaagcggttggcaccactgaagtgaccgaatgagagactctacaggggcaggtaattcactggtccacaagcggtctcctttacgtcgaaaccaaaagaccccaacatccttgaccaagctgtctttacaggatggacataaagccaaaaagccagcatgtaaatttgaagagggtcaggatgtcctagctagatggtcagatggcttgttttatcttggcactatcaaaaagataaacatattgaaacagagctgcttcatcatatttgaagacagttctaaatcctgggttctctggaaggacattcaaacaggagccactggaagtggggaaatggtctgtacaatatgtcaagaagagtattcagaagctcccaatgaaatggttatatgtgacaagtgtggccaaggatatcatcagttgtgtcacacacctcatattgattccagtgtgattgattcagatgaaaaatggctctgtcggcagtgtgtttttgcaacaacaacaaagaggggtggtgcacttaagaaaggaccaaatgccaaagcattgcaagtcatgaagcagacattaccctatagtgtggcagaccttgaatgggatgcaggtcataaaaccaatgtccagcagtgttactgctattgtggaggccctggagactggtatttgaagatgctacagtgctgcaaatgtaagcagtggtttcatgaggcttgtgtgcaatgccttcaaaagccaatgctatttggagacagattttatacgtttatatgctctgtctgcagttctggaccagaatacctcaaacgtctaccattacagtgggtagatatagcacacctatgcctttacaacctaagtgttattcataagaagaaatactttgattctgaacttgagcttatgacatacattaatgaaaactgggatagattgcaccctggagagctggcagacacaccgaaatctgaaagatatgagcatgttctggaggcattaaatgattacaagaccatgtttatgtctgggaaagaaataaagaagaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaagcaatggcatagaaaaaaaaggaaagaaaaaatctgtaggtcgtccacctggcccatatacaagaaaaatgattcaaaaaactgctgagccacttttggataaggaatcaatttcagagaatcctactttggatttaccttgttctatagggagaactgagggaactgcacattcatccaatacctcagatgtggatttcacgggtgcttccagtgcaaaagaaactacctcgtctagcatttccaggcattatggattatctgactccagaaaaagaacgcgtacaggaagatcttggcctgctgcaataccacatttgaggagaagaagaggtcgtcttccaagaagagcactccagactcagaactcagaaattgtaaaagatgatgaaggcaaagaagattatcagtttgatgaactcaacacagagattctgaataacttagcagatcaggagttacaactcaatcatctaaagaactccattaccagttattttggtgctgcaggtagaatagcatgtggcgaaaaataccgagttttggcacgtcgggtgacacttgatggaaaggtgcagtatcttgtggaatgggaaggagcaactgcatcctgactgtaggactgaacattatgttcactgcactctgattttctgtaggtacagttcaaagccctaaagggagtctggcttttactatctttcttaaaaaaaaaaaaaaagagtcaaaaaaattcaaaaaaggggatgatactagccttaacatgtacctgtcaatgttatggatattgtcataaaaaggtatcttttaaaaatcagaacagagacttaattttttaaatcttaagatttgtagaatgtttctaggataggatattaaaaatgattgaaacccatgcatggtgttagacaatttttctaattattccattgagtcagttttttgtgattagtgattatcagagcaaacatcatgtagatagcacaagtatttggagaaacgttgtttgttttgattagtgattatcagagcaaacatcatgtagatagcacaagtatttggagaaacgttgtttgttttgttaccaaaatgttggaaaaatttatttcaataccttttagatttcataaagtgcagtgtatataatgcctactgaaagactgtaaaatattgaaattttctttcaagcaaagtgtaaaaaaatatattgagcctgtaaattgcaaaaaaaaaaaaa

SEQ ID NO: 1375 - DNA, 2263 bp, Homo sapiens
attcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcctcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgc

SEQ ID NO: 1376 - DNA, 1696 bp, Homo sapiens
caaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggca

SEQ ID NO: 1377 - DNA, 848 bp, Homo sapiens
cagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactgggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaa

SEQ ID NO: 1378 - DNA, 2493 bp, Homo sapiens
ggaggcgaactgtgggccccggccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtgacacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaaaaaaaaaa

SEQ ID NO: 1379 - DNA, 1247 bp, Homo sapiens
  Modified_base 1184: n = a,c,g, or t
ggaattcgccgcccgctccgagcctggtgcttccgaccgctgcgcgcggctcctgggctgtcacagtctcccgttgccgccgtcatgtcccggcagctgtcgcgggcccggccagccacggtgctgggcgccatggagatggggcgccgcatggacgcgcccaccagcgccgcagtcacgcgcgccttcctggagcgcggccacaccgagatagacacggccttcgtgtacagcgacggccagtccgagaccatccttggcggcctggggctccggctgggcggcagcgactgcagagtgaaaattgataccaaggccattccactgtttgggaactccctgaagcctgacagtctccggttccagctggagacgtcactgaagcggctgcagtgtccccgagtggacctcttctacctgcatatgccagaccacagcaccccggtggaagagacactgcgtgcctgccaccagctgcaccaggagggcaagttcatggagcttggcctctccaactatgcagcctgggaagtggccgagatctgtaccctctgcaagagcaacggctggatcctgcccactgtgtaccagggcatgtacaatgccatcacccggcaggtggaaacggagctcttcccctgcctcaggcactttggactgaggttctatgccttcaaccctctggctgggggcctgctgaccggcaagtacaagtatgaggacaaggatgggaaacagcctgtgggccgcttctttgggaatacctgggcagagatgtacaggaatcgctactggaaggagcaccactttgagggcattgccctggtggagaaggccctgcaggccgcgtatggcgccagcgcccccagcatgacctcggccaccctccggtggatgtaccaccactcacagctgcagggtgcccacggggacgcggtcatcctgggcatgtccagcctggagcagctggagcagaacttggcagcggcagaggaagggcccctggagccggctgtcgtggacgcctttaatcaagcctggcatttggttgctcacgaatgtcccaactacttccgctaggcccatcgtttctcaggctgcccaaggctcttctgtaacatcttttgttactcacattttctttaatttagaactgcctcagtaaattcttagggatggaagtntttggacaaaaacctaatagaagagtcaccaccaaatgaagaataaaactcccaaaaaaaaaa

SEQ ID NO: 1380 - DNA, 3018 bp, Homo sapiens
ctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgacgtgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagtggccaagggctgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtc

SEQ ID NO: 1381 - DNA, 1885 bp, Homo sapiens
tcgcccggtcgacgccgcggctgccggacgggacgggaccggctaggctgggcgcccccccgggccccgccgtgggcatgggcgcactggcccgggcgctgctgctgcctctgctggcccagtggctcctgcgcgccgccccggagctggcccccgcgcccttcacgctgcccctccgggtgaccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaacaattaaaaaaaaaaacttcattctaaaccaaaaaaaaaaaaaaaaaa

SEQ ID NO: 1382 - DNA, 1507 bp, Homo sapiens
aaacagttgccttttcctctcacagaaggaagatttcattttgtttgagacgagaaaccaaaccacacaccaaagagaggggtatgatggctaagaagcccccaaaaccagcccctcgcaggatcttccaggaaaggttaaagattactgctctacctttgtactttgaaggttttttattaatcaagcggtcaggataccgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacagtaacagagctgtcagttccccaaaacgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaagaggcaactgagatgctccagaagaacccttctttgggaaatatgatcctgaggcctggtagtgacagtagaaactactccatcactattcggcaggagatagacattccaagaatcaagcactacaaagtgatgagcgtaggacaaaactacactattgaactggaaaaacctgtaacactcccaaaccttttcagtgtcattgattattttgtgaaggagactcgaggaaatttaagaccatttatatgttcaactgatgaaaacactggtcaagaacccagtatggaagggagaagtgaaaagttgaagaaaaatccacacattgcatgaaatacaatgtgaaagctcctttgtatatcttggtaatttatattttcaaaacgaagttcttacttttaaagagaattacctatattctcctgatactgattaccaagtcattcacctgaacaccagaattagaattaaacattgtaccatacaatttcattatcttatcagaatgaaaccaattcacagggaaactagagactacggctgtggtggtaacctgcagatatacacattcccatgcactgacataagttgaaaacacatagtactttctagatggaatttttttctttaggcctcaatgaaatacatttcccctatataattccaacagcagtttctctagttctaaattttaccaattcccaaaaaacctaagttttgctgaaatctgatttgaccaatttatcaaatatgtcattttaattacctagctggaagttagagacatgaaatgtactagaggagcccttttccaatggaaatattatataccacattttttgttaatggaaataaatgtctccattccc

SEQ ID NO: 1383 - DNA, 1034 bp, Homo sapiens
tgtcggcctctgggcggatgttgacattgtgttgttgttattgctgatggtaatggcggcggcggtggcggcgacggtccagaccccatcccctctgtagccggagccgagacagccgacagcgaactccgcggcctcggagccggcggcagcggcgactcccctcagcctccgccgcctcgcccgccggtaccccggcgccaaccccgggagtcaggccctttgggcaggggagctcggaggctcaggatggcggatttcgacgaaatctatgaggaagaggaggacgaggagcgggccctggaggagcagctgctcaagtactcgccggacccggtggtcgtccgcggctccggtcacgtcaccgtatttggactgagcaacaaatttgaatctgaattcccttcttcattaactggaaaagtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagaacacgaagatcgattgagaagttattagaatgggaaaacaataggttataccacaagctgtgcttgcattggagactgagcaaaaggaaatgtgaaacgaataacatgatggaatatgtcatcctcatagaatttttaccaaagacaccgatttttcgaccagattagcatttactttatttatagagactttccaagtatgttgtctttccaatggtgccttgcttggtgctctcctggtggtgacataacattggttctacagaatcgtgtggtgttttttttgtttttgttttttttttttttttaaataaccgcatgttctaagtgtgcatttttgtcaatctttgcaacagttatttcatacagatgtttaatacttaagttattgtgctcttttctgttatgtattctgattttcaaggattactttttttgtattatcaaaaaaatac

SEQ ID NO: 1384 - DNA, 2058 bp, Homo sapiens
cggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgacttgcatcagactggaggtgaagttaccatttcagtatatgctaaaaactcacttccagaacttagccgagtagaagcaaatagcacattgttaaatgtcattattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgacacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgttaaaaaaaaaaaaaaaaaaa

SEQ ID NO: 1385 - DNA, 1618 bp, Homo sapiens
agagcccggggcgagtgggcctctgctcgtgggtggttctcgtggaggtcagctcccgcgtgtctccgctcgacagggtgcttgggcagagcccatcgggtaggcgcgggccatggcgcagtacaagggcaccatgcgcgaggcaggccgtgccatgcacctcctcaagaagcgcgaaaggcagcgggagcagatggaggtgctgaagcagcgcatcgccgaggagaccatcctcaagtcgcaggtggacaagaggttctcggcgcattacgacgccgtggaggccgagctgaagtccagcacggtgggcctggtgaccctgaacgacatgaaggcccggcaggaggccctggtcagggagcgcgagcggcagctggccaagcgccagcacctggaggagcagcggctgcagcaggagcggcagcgggagcaggagcagcggcgcgagcgcaagcgtaagatctcctgcctgtcctttgcactagacgacctcgatgaccaggccgacgcggccgaggccaggcgcgccggaaacctgggcaagaaccccgacgtggacaccagcttcctgccagaccgcgaccgcgaggaggaggagaaccggctccgagaggagctgcgccaagagtgggaggcgcagcgcgagaaagtgaaggacgaggagatggaggtcaccttcagctactgggacggctcgggccaccggcgcacggtgcgggtgcgcaagggcaacacggtgcagcagttcctgaagaaggcgctgcaggggctgcgcaaggacttcctggagctgcgctccgccggcgtggagcagctcatgttcatcaaggaggacctcatcctgccgcactaccacaccttctacgacttcatcatcgccagggcgaggggcaagagcgggccgctcttcagcttcgatgtgcacgatgacgtgcgcctgctcagcgacgccaccatggagaaggacgagtcgcacgcgggcaaggtggtgctgcgcagctggtacgagaagaacaagcacatcttccccgccagccgctgggaggcctatgaccccgagaagaagtgggacaagtacaccatccgctaacacccgcctgccagagcggaaaccgggggtggggggagacactcatttctaggccccatcaccagtcacttgatttcgtgaccttgatttcttcccccaaatttaataaagacagagggttctcatgattcacattggttgtgctattgctgatgttatgctttggttgcttggttggtcttttctgagtattttagtgttgccacctggatttgctgcattgctctgctgagctgtattgaaaccatgactgggcccactgtcagacagaaattagaataggaggcacattttttacctggtggttatgagcatggacttgggggccacagtgactgagtttgattcccgacacagcctcctccttgctgtgtagttttgggtaagcttattaaacccccatgcctcagtttggtcacctgtaaaaggaaataacaagagcacttactttataagattgatgtgagtattaagtgaattaatatttgtaaaacgcttagctcttaataaatgtttctgttgttatta

SEQ ID NO: 1386 - DNA, 1548 bp, Homo sapiens
cgttgctgtcggtggagcggctgtcgcagtgcggctccggcagtggcagcggaggcctgtgtttgcggccttcggcaagcgactgagatggcgagcgcaactgcaccctgcagccgcagtccccacccctggcttcgccctttggagcagctccggcacttggcggaggagctgcggttgctcctgcctcgagtgcgggtcggcgaagaccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagatggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgacatggacaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtgattaaaaaaaaaaaaaaaaaaaaa

SEQ ID NO: 1387 - DNA, 1743 bp, Homo sapiens
gccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacctaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcttc

SEQ ID NO: 1388 - DNA, 2269 bp, Homo sapiens
ccacccccggccccgaagctccgccacccgccgccatgagtagctttggagctggcaaaaccaaagaagttatcttcagtgtggaggatggctccgtgaaaatgttcctgaggggccgccctgtgcccatgatgatcccagacgagctggcacccacctacagcctggacacacgctcggagctgccttcttgccggctcaagctggagtgggtctatggctaccgtggccgagactgccgggccaacctttatttgctgcccaccggggagatagtgtactttgtggcctccgtagccgtgctatacagcgtggaggagcagaggcagcgacactacctgggacacaacgatgacatcaaatgcttggccatccacccagatatggtcaccatcgccacgggacaggtggcgggaaccactaaggaagggaagccgctgccgccccacgtgcgcatctgggactcagtttccctctccaccttacacgtgctgggcttgggggtgtttgacagagccgtgtgctgtgtgggcttctccaaatctaatggaggcaacctgctgtgtgcagtggatgaatccaatgatcacatgctctcggtgtgggactgggccaaggagaccaaggtggtggatgtcaagtgctccaatgaggctgtattggtggccaccttccaccccacggaccccactgtgcttatcacctgcgggaaatctcacatctacttctggaccttggaggggggcagcttgagcaagcggcaaggcctctttgagaaacatgagaaaccgaagtatgtgctgtgtgtgacctttttggaaggtggcgacgtggtcacgggggactctggggggaacctctatgtttggggcaaaggtgggaaccgtatcacacaggcggtgctgggcgcccacgacggcggcgtgtttgggctctgcgccctgcgggacgggacgctggtgtctggagggggccgtgatcggcgggtggtcctctggggttctgactacagcaagctgcaggaagtggaggtccctgaggactttggccctgtgcgcaccgtggcagagggccacggagacacactgtacgtggggaccacccgcaattccatcctgcagggctccgtgcacacaggcttctcactgctggtccagggccatgtggaagagctgtggggcctggccacacaccccagtcgggcccagtttgtgacctgcgggcaggataagctggtgcatctatggagctcagattcccaccagcccctgtggagcaggatcatcgaggaccctgcccgctcagccggcttccaccccagtggctctgtcctggctgtgggtacagtgactggcagatggctgctgctggacacggagacccatgacctggtggctatccacacagacggcaatgaacagatctcagtggtcagcttctccccagacggggcgtacctggccgtgggctcccacgacaacttggtgtacgtgtacacggtggaccagggcggccgcaaggtcagccgcctgggcaagtgctcgggccattccagttttatcacccacctggattgggcccaggacagcagctgctttgtcaccaactccggggactatgagattctgtactgggacccggctacctgtaagcagatcaccagtgcggatgctgtgaggaacatggaatgggccacagctacttgtgtcctagggtttggggtgtttgggatctggtctgagggggcggacggcactgatatcaacgctgtggcccgctctcatgatgggaagttgctggcttcagctgatgactttggcaaagttcacctgtttagctacccctgctgtcagcctcgagccctcagccacaagtacggtggacacagcagccatgtgacaaatgtggccttcttgtgggatgacagcatggccctgaccacagggggcaaggacaccagtgtgctacagtggcgggtggtctgatgcggccagggaagagtcaggtgtcagggcaggaattctattttcgggagatgtctattgccgagtagagtaatatatacccagagtatgtctatagcagagggggttatgggggcgggagggtagactgacatacagaagtctctatttatccgggtgggaagagggagtcacatcgctttggggatccattggtgtttggtttggggtgttttttaagttttttcttttatatcatccagaaataaagacacgtacactaaaaaaaaaaaaaaaaaaaaaaa

SEQ ID NO: 1389 - DNA, 2397 bp, Homo sapiens
ctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatgacactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaacggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgggagttaagaatgaaatccttcaagtgttataaactcacattttaaaagcaaattttggttcc

SEQ ID NO: 1390 - DNA, 2076 bp, Homo sapiens
aggttgctcagctgcccccggagcggttcctccacctgaggcagacaccacctcggttggcatgagccggcgcccctgcagctgcgccctacggccaccccgctgctcctgcagcgccagccccagcgcagtgacagccgccgggcgccctcgaccctcggatagttgtaaagaagaaagttctaccctttctgtcaaaatgaagtgtgattttaattgtaaccatgttcattccggacttaaactggtaaaacctgatgacattggaagactagtttcctacacccctgcatatctggaaggttcctgtaaagactgcattaaagactatgaaaggctgtcatgtattgggtcaccgattgtgagccctaggattgtacaacttgaaactgaaagcaagcgcttgcataacaaggaaaatcaacatgtgcaacagacacttaatagtacaaatgaaatagaagcactagagaccagtagactttatgaagacagtggctattcctcattttctctacaaagtggcctcagtgaacatgaagaaggtagcctcctggaggagaatttcggtgacagtctacaatcctgcctgctacaaatacaaagcccagaccaatatcccaacaaaaacttgctgccagttcttcattttgaaaaagtggtttgttcaacattaaaaaagaatgcaaaacgaaatcctaaagtagatcgggagatgctgaaggaaattatagccagaggaaattttagactgcagaatataattggcagaaaaatgggcctagaatgtgtagatattctcagcgaactctttcgaaggggactcagacatgtcttagcaactattttagcacaactcagtgacatggacttaatcaatgtgtctaaagtgagcacaacttggaagaagatcctagaagatgataagggggcattccagttgtacagtaaagcaatacaaagagttaccgaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaaggttctacttatagtcgacacaatgaattctctgaggttgccaagacattgaaaaagaacgaaagcctcaaagcctgtattcgctgtaattcacctgcaaaatatgattgctatttacaacgggcaacctgcaaacgagaaggctgtggatttgattattgtacgaagtgtctctgtaattatcatactactaaagactgttcagatggcaagctcctcaaagccagttgtaaaataggtcccctgcctggtacaaagaaaagcaaaaagaatttacgaagattgtgatctcttattaaatcaattgttactgatcatgaatgttagttagaaaatgttaggttttaacttaaaaaaaattgtattgtgattttcaattttatgttgaaatcggtgtagtatcctgaggtttttttccccccagaagataaagaggatagacaacctcttaaaatatttttacaatttaatgagaaaaagtttaaaattctcaatacaaatcaaacaatttaaatattttaagaaaaaaggaaaagtagatagtgatactgagggtaaaaaaaaaattgattcaattttatggtaaaggaaacccatgcaattttacctagacagtcttaaatatgtctggttttccatctgttagcatttcagacattttatgttcctcttactcaattgataccaacagaaatatcaacttctggagtctattaaatgtgttgtcacctttctaaagctttttttcattgtgtgtatttcccaagaaagtatcctttgtaaaaacttgcttgttttccttatttctgaaatctgttttaatatttttgtatacatgtaaatatttctgtattttttatatgtcaaagaatatgtctcttgtatgtacatataaaaataaattttgctcaataaaattgtaagcttaaaaaaaaaaaaaaaaaactcgagactagtgc

SEQ ID NO: 1391 - DNA, 1247 bp, Homo sapiens
cgcgggaggacagcgctgcgaggaggcgcccgggacagtcatggagcgccgcctgggagtgagggcctgggtgaaggagaaccggggctccttccagcccccggtctgcaacaagctcatgcaccaggagcagctcaaagtcatgttcgtcggaggccccaacaccaggaaggactatcacatcgaagagggtgaagaggtattttaccagctggagggagacatggttctccgagtcctggagcaagggaaacaccgggatgtggtcattcggcagggagagatattcctcctgcctgccagggtgccccactcaccacagaggtttgccaacaccgtggggctggtggttgagcgaaggcggctggagaccgagctagatgggctcaggtactatgtgggcgacaccatggacgttctgtttgagaagtggttctactgcaaggacctcggcacgcagttggcccccatcatccaggagttcttcagctctgagcagtacagaacaggaaagcccatccctgaccagctgctcaaggagccaccattccctctgagcacacgatccatcatggagcccatgtccctggatgcctggctggacagccaccacagggagctgcaggcaggcacaccactcagcctgtttggggacacctatgagacccaggtgatcgcctatgggcaaggcagcagcgaaggcctgagacagaatgtggacgtgtggctgtggcagctggagggctcctcggtggtgacaatggggggacggcgcctgagcctggcccctgatgacagcctcctggtgctagctgggacctcgtatgcctgggagcgaacacaaggctctgtggccctgtctgtgacccaggaccctgcctgcaagaagcccctggggtgaccctcttgccatggcctgaagcagccacaggttggccaagcaccctcgagtgccatccctgccaaacaactctcccagcccccactacctctctgtgtactgccgctgtgtcccccacagacctgcacattgttgtcacccaccctcctgcccttctcagcccagatgccatgccctgggcgggcagcagctccccatcttctctggcagactcagcccactgccttgccagtcttgccaggtggtctacccccggccccgctcctgcccattcctctgtccctgcagactcagtgcagcacttccacaccaagaaggccctcaataaaggcttcctgaggaacgc

SEQ ID NO: 1392 - DNA, 2115 bp, Homo sapiens
gaaatgaacctctcttattgatttttattggcctagagccaggagtactgcattcagttgactttcagggtaaaaagaaaacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaagaaaaactgattgcttatcaacgagaattccttgctttgaaagaacgtcttcgaatagctgaacacagaatctcacagcgctcttctgaattaaatacgattgtgcaacagttcaagcgtgtaggagcagaaacaaatggaagtaaggatgcgttgaataagttttcagataataccctaaagctgttaaaggagttaacaagcaaaaaatctcttcaagtgccaagtatttattatcatttgcctcatttattgaaaaatgaaggaagtcttcaacctgctgtacagattggcaacggaagaacaggagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagattcatattaaaaaagccaccaactgatcatctgagaaaccaacacattttttcctgtgaatttgttaattaaagatagttaagcatgtatcttttttttatttctacttgaacactacctcttgtgaagtctactgtagataagacgattgtcatttccacttggaaagtgaatctcccataataattgtatttgtttgaaactaagctgtcctcagattttaacttgactcaaacatttttcaattatgacagcctgttaatatgacttgtactattttggtattatactaatacataagagttgtacatattgttacattctttaaatttgagaaaaactaatgttacatacattttatgaagggggtacttttgaggttcacttattttactatt

SEQ ID NO: 1393 - DNA, 1081 bp, Homo sapiens
ggcggcggcgacgctgcctcctcaccggcgcaggctaggagggggcggcctgagtgccgtagccgagccggggctggagcgcgcggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacgttctggacacagctgggcaggaggaattcagcgccatgcgggagcaatacatgcgcacgggggatggcttcctcatcgtctactccgtcactgacaaggccagctttgagcacgtggaccgcttccaccagcttatcctgcgcgtcaaagacagggagtcattcccgatgatcctcgtggccaacaaggtcgatttgatgcacttgaggaagatcaccagggagcaaggaaaagaaatggcgaccaaacacaatattccgtacatagaaaccagtgccaaggacccacctctcaatgtcgacaaagccttccatgacctcgttagagtaattaggcaacagattccggaaaaaagccagaagaagaagaagaaaaccaaatggcggggagaccgggccacaggcacccacaaactgcaatgtgtgatcttgtgacaggcctgaaggcctcgggcacagtgacggtggcctggccagccctcgggacccctccccacctaactgcactgaaaccatttctaaccacaacccttggcccaaggacttggtacaggaagggagaagggcaggtgggcagggagcaagacagggtctggcttttgccaagaggaacggggctttttccaccttcttcaaaagagacaagggaaggccacctgttaaagcaggaagcagcatcaagttgccccttgggcccccccatgttgtttggatttcaaaccgggtttccttcccccttcttttcgggttgggtgttgttggttatttggttaactacatatggtt

SEQ ID NO: 1394 - DNA, 1554 bp, Homo sapiens
ggccattaccaatcgcgaaaccccgcagggggctcccggaccctgactctgcagccgaaccggcacggtttcctggggacccaggcttgcaaagtgacggtcattttctccttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcgggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaaaaaaaaaaaaaaaaaaaaaaaaaaaaaaaaaaaaa

SEQ ID NO: 1395 - DNA, 612 bp, Homo sapiens
atggccgcggcggctggcggacggctccggcaggagaagtaccggctcgtggtggtcggcgggggcggcgtgggcaagtcggcgctcaccatccagttcatccagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctag

SEQ ID NO: 1396 - DNA, 2103 bp, Homo sapiens
cccaggaacccccagggagccagcatgaagcgagctcaccccgagtacagctcctcggacagcgagctggacgagaccatcgaggtggagaaggagagtgcggacgagaatggaaacttgagttcggctctaggttccatgtccccaactacatcttcccagattttggccagaaaaagacggagaggaataattgagaagcgccgacgagaccggatcaataacagtttgtctgagctgagaaggctggtacccagtgcttttgagaagcagggatctgctaagctagaaaaagccgagatcctgcagatgaccgtggatcacctgaaaatgctgcatacggcaggagggaaaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaaactgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaa

SEQ ID NO: 1397 - DNA, 1749 bp, Homo sapiens
gatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatctgatcacagaacaggccgatatcgcattgacccggggagctgaggtgaagggccgctgtggccacagccagtcggagctgcaagtgttctgggtggatcgcgcatatgcactcaaaatgctctttgtaaaggaaagccacaacatgtccaagggacctgaggcgacttggaggctgagcaaagtgcagtttgtctacgactcctcggagaaaacccacttcaaagacgcagtcagtgctgggaagcacacagccaactcgcaccacctctctgccttggtcacccccgctgggaagtcctatgagtgtcaagctcaacaaaccatttcactggcctctagtgatccgcagaagacggtcaccatgatcctgtctgcggtccacatccaaccttttgacattatctcagattttgtcttcagtgaagagcataaatgcccagtggatgagcgggagcaactggaagaaaccttgcccctgattttggggctcatcttgggcctcgtcatcatggtaacactcgcgatttaccacgtccaccacaaaatgactgccaaccaggtgcagatccctcgggacagatcccagtataagcacatgggctagaggccgttaggcaggcaccccctattcctgctcccccaactggatcaggtagaacaacaaaagcacttttccatcttgtacacgagatacaccaacatagctacaatcaaacaggcctgggtatctgaggcttgcttggcttgtgtccatgcttaaacccacggaagggggagactctttcggatttgtagggtgaaatggcaattattctctccatgctggggaggaggggaggagggtctcagacagctttcgtgctcatggtggcttggctttgactctccaaagagcaataaatgccacttggagctgtatctggccccaaagtttagggattgaaaacatgcttctttgaggaggaaacccctttaggttcagaagaatatggggtgctttgctcccttggacacagctggcttatcctatacagttgtcaatgcacacagaatacaacctcatgctccctgcagcaagacccctgaaagtgattcatgcttctggctggcattctgcatgtttagtgattgtcttgggaatgtttcactgctacccgcatccagcgactgcagcaccagaaaacgactaatgtaactatgcagagttgtttggacttcttcctgtgccaggtccaagtcgggggacctgaagaatcaatctgtgtgagtctgtttttcaaaatgaaataaaacacactattctctggc

SEQ ID NO: 1398 - DNA, 1826 bp, Homo sapiens
cacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttc

SEQ ID NO: 1399 - DNA, 1370 bp, Homo sapiens
ctggccaccaagcgcctccgtggacacgcacttcctgcgagggctccgtgcgcaccttggccgagccgaaccgagccgagtcctgtccttccaggccgttcgcaatggtggatgagttggtgctgctgctgcacgcgctcctgatgcggcaccgcgccctgagcatcgagaacagccagctcatggaacagctgcggctgctggtgtgcgagagggccagcctgctgcgccaggtacgtccgccgagctgcccggtgcccttccccgaaacgtttaatggcgagagctcccggctccccgagtttatcgtgcagacggcgtcttacatgctcgtgaacgagaaccgattctgcaacgacgccatgaaggtggcattcctaatcagcctcctcaccggggaagccgaggagtgggtggtgccctacatcgagatggatagccccatcctaggtgattaccgggccttcctcgatgagatgaaacagtgctttggctgggatgacgacgaagacgacgacgacgaagaagaggaggatgattattaggccctcgaccctcgggcctcgggggggagggccctgcacgccgccaccccctccccgcagccctcaccccgccaggagccactgctctcccccttgccctccggtccccttacctacccgcgcccgtctgctctctctcttcatttctccgtagtgcttgtctttgttccaggaatagcgctccagttacctgctgctggggtcggggctggagcctcactcactcggaagtgcttggaagtgtcatctaccctggccatccccgggatccctcccctgctaatctgaactgtgtcctgaaccccagctattggccaggcccctgttacaaactgcgcagaccacccgtagccctgctgctgccacctgccctgctgccaggcttacatcttcccagagaactatgctgccacttcacatccactcaccacatcccacctacagactaccacctttcgagatcaggaccaacctggaaaatgccagagttggctatgccttttcagacattgatttggacagctcaccaacccctgaaggggccgttcagcctggttagttttctacctactccgagtgtcctcccctgccccaccagattgctgcaggggcgcggtgtgcctggcagccaaattgttgacacttcttttttcctatgcactggttttacacagctgtcatttttctttcaaaattgcagcagtcccacagatgtgtgcatttggacaaatagtacttaaaaacaaaacaaacaagcactcagcccagctcctcaatactacctggaaaaagcattggcattattttcaataaatatcaagcacc

SEQ ID NO: 1400 - DNA, 2744 bp, Homo sapiens
ctcgtgccgaattcggcacgagaccgcgtgttcgcgcctggtagagatttctcgaagacaccagtgggcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagaccacgagcatcactctgaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactttggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtg

SEQ ID NO: 1401 - DNA, 1954 bp, Homo sapiens
acaccctctgccgactccaagacgctgcctcttcctgcgggcgaggcgcgcggtctggtactcgtgcgtcttttatcgcctgagtttccctccgccgactagcgcgcggggcccggttctccatcgcgcgcacggcagcctagcgcaatgaggcgggcaccctgcgttcgagataagttgcgggagatagtaggagcatccacaaactggagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaagatttggcaggattcttgaggatcttgacagcttgggagttcttatttgttacatgcacaacaaaatccactccgccaagatgtctcctttatcgatagttacagccctggtggataagattgatatgtgtaagaagagcttgagcccagaacaggacattaagttcagtggccatgttagctgggtcgggaagacatccatggaagtgaagatgcaaatgttccagttacatggtgatgaattttgtcctgttttggatgcaacatttgtaatggtggctcgtgattctgaaaataaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagacaattttaattgtgaacctaccatgttgcctcccatcttctgaaaaaacaaaaaaattataggcatgagccactgcacccggccggtggaaagcatttttaacaaaaaatttttaggccaggcacagtggtggctcatgcctgtaatcccagcactttgggagactgagatgggaggatcgcttgagaccagcctggggaacatagtgagaccctttctctacaaaaagttaaaaaattatctgagcatggtggtgtgcacctgtagtcccagttaggaggctgaggtgagtggattgcttgagtccgggagtttgagtctgcagtgagctatgatcatgccactgcactccagtctgggtgacagcaagac

SEQ ID NO: 1402 - DNA, 1606 bp, Homo sapiens
gcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccgctcaaaaaaaaaaaaaaaaaaa

SEQ ID NO: 1403 - DNA, 1850 bp, Homo sapiens
cggcgccggggcggcagcagaagtccggagtcagggcgtgtggctgaggagatgccactaagcacagctggcatcctgagctcctcttctgccgcttccaacaggtcaaggaataaggctcgctatcggaccaaagccgtgagctctgaggtggatgagagcctctttggagatatcaagtccccagcccagggccagagcgacagccccattgtgctgctccgagataagcatacccttcaaaaaactctcactgctttgggcttggatcgcaagccagagaccatccagctcatcacccgggacatggtccgagaactcattgttcccacagaggatccctccggggagtccctaatcatcagccctgaggagtttgagcgaatcaaatgggcatcccatgtcctgaccagagaagaacttgaggccagggaccaggccttcaagaaggagaaggaagccaccatggatgcagtgatgacacgaaagaagatcatgaaacagaaggagatggtgtggaacaacaacaagaagctcagtgacctggaggaggtggccaaggaacgggcccagaacctcctgcagagagccaacaagctgcggatggagcaggaggaggagctcaaggacatgagcaagattatcctcaatgctaagtgccatgccatccgggatgcccaaatcctggagaagcagcagatccaaaaagaactggacacagaagagaagcggttggatcagatgatggaagtggagcggcagaaatccattcaaaggcaggaggaactggagaggaagaggagggaggaaagaattagaggaaggcggcaaattgtggaacagatggaaaagaaccaggaggagcgatcgctgcttgctgagcagcgggagcaggagaaggagcagatgctggaatatatggaacagctccaagaggaagatctaaaggacatggaacgaaggcagcaacaaaaactgaagatgcaagctgagattaagcgcatcaatgatgaaaaccagaaacagaaagcagaactgctggctcaggagaagctggcagaccagatggtgatggagtttaccaagaagaagatggctcgagaagcagagtttgaggctgagcaggagagaatccggagggagaaagagaaggagatcgcacgcttgagggccatgcaggagaaggcccaggattaccaggcagaacaggatgccttgcgggccaagcgcaaccaggaggttgcagacagagagtggcgcagaaaggaaaaggaaaatgcgcggaagaagatggaaacagaggctgagctgcgaaaaagtcggctcgaacaggtggctttcaaggagcacgctctggctgttcaggtgcacgggaccgggatgagttcgagaggattcttcgggctcagagagaacagattgagaaggagcggctggaggaggagaaaaaggccacagggcgcttacagcatgccaatgagctccggcgccaggtgcgcgagaaccagcagaaggaagtgcagaaccggattgccacctttgaggggggccggcgcctcaaagaggaggcccagaaacgccgtgagcgcatcgatgagatcaagaggaaaaagcttgaagagctgagagccactggccttcccgagaagtactgcattgaagctgagcgcaaagctaacatcctgccagctacctctgtgaactgaggggagccttcgtggccctcaggatgccttcgggggacagattctgcccagtctctgggcatccataattgctgctaacctagacatttcatagttacagattaaatctacttgactaaaaaaaaaaaaaaaaaaaaaaaaaaa

SEQ ID NO: 1404 - DNA, 1703 bp, Homo sapiens
gaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacttctcagtcaacatcgtggggctggacagggttgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacaggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaataataaaaacatgttttgttttgttaaaaaaaaaaaaaaaaa

SEQ ID NO: 1405 - DNA, 2414 bp, Homo sapiens
cccgcgtgcatacggttgccggcatggcacattacaacttcaagaaaattacggtggtgccgtccgccaaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgatattcatccgttctatgctgatttgatgaatattctctacgacaaggatcattacaagttggctctggggcaaataaatattgccaaaaatttagtggacaatgttgctaaagattatgtgcgactgatgaagtatggcgactctctctaccgctgcaaacagctgaagcgtgcggccctgggacggatgtgcacagtgatcaagaggcagaagcagagtttggagtatttggagcaagtgcgtcagcatttatcccgtttgccaaccattgatccgaataccaggaccctgcttttgtgtgggtacccaaatgttgggaagtccagcttcatcaacaaggtgacgagagcagacgtggatgtccagccctatgcgttcacaaccaagtctctgtttgttgggcacatggattataagtatctacgttggcaggttgtagacactcctgggatcctggaccaccctctggaggataggaacaccatcgagatgcaggccatcactgccctggcccacctccgtgctgcggtcctgtatgtgatggatttgtctgagcagtgtgggcatgggctgagggagcagctagaactcttccagaacatcagacctctcttcatcaacaagcctctcatagttgtagccaacaaatgtgatgtgaagagaatagctgaactttctgaagatgatcagaaaatatttacagatttgcagtctgaaggattccctgtaatagagaccagcaccctgactgaggaaggtgttattaaagttaaaacagaggcttgcgataggcttttggctcatcgagtggaaaccaaaatgaagggaaataaagtgaatgaggtgctgaatagactgcacctggctatcccaaccaggagggacgataaggagaggccccctttcatccctgaaggagtggtggctcgcaggaagaggatggaaactgaggagtccaggaagaagagggaacgagatcttgagctggaaatgggagatgattatattttggatcttcagaagtactgggatttaatgaatttgtctgaaaaacatgataagataccagaaatctgggaaggccataatatagctgattatattgatccagccatcatgaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggttcagaggacagttttggagaaggagatgcgtagtcttggtgttgacatggacgataaagacgatgcccattacgcagtccaggcaagaagatcccggagcatcactaggaaaagaaagcgggaagactctgctcccccgtcctctgtggcccggagtgggagttgctctcgaactccacgtgacgtttctggtcttagggatgtcaagatggtgaagaaagccaagactatgaagaatgctcagaagaagatgaatcggttggggaagaaaggggaggcggatagacacgtgtttgatatgaagcccaagcacttgctgtctgggaagaggaaagctggtaaaaaggacaggagatagtatccgtttggttggcgtggcttcgctagagtgttgctgtttatttcctggtttggtacagtatggtttcatgaaattggagctctgtacaaactgaaaaagacaaaataagtaaagcacttgttgctttgctgaaaactatggttaaccctatataggtgtgggaaatttttgtcactgcataatattacaaatattttgagtagacagtgtttccacatttaatggagtatcagttgcttcagattttcagaactgggaagatttactggtgtaactgggttgtttttgatggagaaaaaccttattttcttttgtaagagctgggagcaaacacgtttatgagtgtgtcggaatcccgtgcttaaaatacgctcttaaattattttctagtcttattttacaatgtctcattgtagtctgtcttcaactattttatccaaaataaacctccagaagaaactaaaaaaaaaaaaaaaaaaaaaaaaa

SEQ ID NO: 1406 - DNA, 1894 bp, Homo sapiens
gtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccaccagccctgctggcccctggttccgctggccccccagatgcctggctgagacacgccagtggcctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcggcctggatgaaagagcggacttcacctggggcgattcactactgtgcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctgagtgcctggcccagggcctgaaacccgccctcaggggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccatggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactg

SEQ ID NO: 1407 - DNA, 644 bp, Homo sapiens
gctccctggggaacccagcaggcggcgaagatggcggagaacagcggtcgcgccggcaagagcagcgggagcggcgcggggaagggggcggtgtccgcagagcaggtgattgctggcttcaaccgccttcggcaggaacagcgaggcctggcatccaaagcagctgagttggagatggagttgaatgagcacagcctagtgatcgatacactgaaggaggtagatgaaactcgtaagtgctaccgcatggttggaggagtgctggtggagcgaactgtcaaagaggtgctgcccgctttggagaacaacaaggagcagatacagaagatcattgagacactgacacagcagcttcaggcaaagggaaaagaactaaatgaattccgggaaaagcacaacattcgtctcatgggagaagatgagaagccagcagccaaggaaaactcagaaggggctggggctaaggccagctcagctggagtgttggtctcctagggaccaaggcctttgcatttttttctaccctgactcccacttctaatttctctttattgttattattattattttctctgctattgtaatatttttttgttaattaaatgttttggtcagaatcttaaaaaaaaaaaaaaaaaaaaaaa

SEQ ID NO: 1408 - DNA, 1573 bp, Homo sapiens
ggctgggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagaggcaccgtgtaaagaaaatggcaaaataaatatctttccaaggatcatcatcacgatagctaaacagtacttaaatagcggttggaactaggtagcctttcgaattttatgattttttcatatgtggaaatctattacatgtaatacaaaacaaacatgtagtttgaaggcggtcagatttctttgagaaatctttgtagagttaattttatggaaattaaaatcagaattaaatgctaaaaaaaaaaaaaaaaa

SEQ ID NO: 1409 - DNA, 6229 bp, Homo sapiens
cgccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccagactttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgagttgtttcgaattactgctttcagtgtctgaaagtgaactgccatgtgaagtctggctaccattccttcagtctctacaggagtcacatgatgcattattggaatttgggaataataacctacaaatattggttcatgttaccaaggaaggggtgtggaaaaacccagttcttcttaaaattctgtctcaacagccagtagaaacggaggaagtcaataaattgattgcacaagaaggaccttcctttctgcaaatgcgaataaaacatttgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggagattgcaaaggtcgactgcaaggaagtactagacatcatttgtaatctggaatctgaggggcaggataacacagcatttgttctttgtacgacttaccttacccagcagctccaaactgcaagtgtatattgttcttgggaactgactcttttttggagtaaactgcaaagaagaattgacccttctttagatacttttttggagcgctgtcgtcagtttggtgtcatagctaaaacgcagcagcatttattttgcctcattagagttatacaaactgaagcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatttgtcctaagagcccctctgcaatcccagagcaaaaccattcattgaatgaccaagccaaaggagagtctcatgaatacgtcacattcagcaaattagaagattgccacctgcaagacagagatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcacgaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatgaagcacaacactttagggatgcatcttacacatgcaacttccttggctgtaaaaagttctattactccaaaattgaataccagaatcacctctcaatgcataatgttgaaaattcaaatggagacataaagaaatcagtgaaacttgaggagtctgcaacaggtgaaaagcaagattgtattaatcagccccatctacttaaccaaactgataaatcacatttacctgaagatcttttctgtgcagaatcagctaattctcaaatagatacagaaactgcagaaaacctgaaagaaaacagtgacagtaattctagtgatcagttaagtcatagctcttcagcttcaatgaatgaagagctaattgacacactagatcactctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacggaaggttcatccataccatttcaagcccaaaaagataaagacgaaagatctgtttccctctttgggtaatgaacataatcagacaactgaaaagttggatgcagaacctaaaccctgctcagatacaaacagtgactccccagatgaaggtctagatcacaatattcacattaaatgtaaacgagaacatcaaggttattcctcagaatcctccatttgtgcttctaaaaggccctgtacagaggataccatgttggaacttctgttacgcttgaaacatttaagcttgaaaaactcaataacacatggatctttctcagggtcattgcaggggtacccatccagtggtgctaagtctcttcagtcagtttcatctatctcagaccttaattttcagaatcaagatgaaaacatgccaagtcagtaccttgcacagttggcggctaagccgtttttctgtgagcttcaaggatgcaaatatgaatttgtgaccagagaggctctgttaatgcattatcttaaaaagcataattattcaaaagaaaaagtccttcagttaaccatgttccaacatcggtattccccatttcagtgtcatatttgccaaaggtcatttacaagaaaaacacaccttaggattcattataaaaataaacatcaaattggcagtgacagagcaactcacaaactattagataatgaaaagtgtgatcatgaaggcccatgttcagtagataggttgaaaggtgattgttctgcagaacttggaggtgatcccagtagtaactctgagaaaccacactgtcatcctaaaaaggatgaatgtagttctgaaacagatttggaatcatcttgtgaagaaacagaaagtaaaacatctgacatttcatcaccaataggcagccatagagaagaacaagaaggaagagagggcagaggtagcaggcgaactgttgctaaaggaaatctgtgttatattttgaataaataccacaaaccattccattgtattcataaaacttgcaactcctcattcaccaatctaaaaggcttaattcgccattacagaactgtacatcagtacaacaaagaacagttatgtttggagaaagacaaagcaagaaccaaaagggaacttgtcaaatgtaaaaagatatttgcttgcaaatataaggaatgtaataaacgcttcctgtgttccaaagctcttgctaagcactgtagtgattctcataacctagaccatattgaagagcctaaagtactttccgaagctggatctgcagcaaggttttcttgtaaccagcctcagtgccctgctgttttttatacattcaacaagttgaagcaccacttgatggaacagcataatattgaaggggaaatacattcagattatgaaattcattgtgatcttaatggctgtggccagattttcacccatcgcagtaattactcacaacatgtatattaccgacataaagactattatgatgatttgtttagaagccagaaagtagcaaatgagagactactaaggagtgaaaaggtatgtcaaacagctgatactcaggggcatgaacatcagaccaccaggagatcatttaatgctaagtctaaaaaatgtggcttaatcaaagaaaagaaagccccaataagttttaaaaccagagctgaggccctccatatgtgtgtggagcactctgagctctctctgtacccctgcatggttcaaggatgcttatctgtggtgaagttggagagcagcattgtgaggcattacaaacgcactcatcagatgagtagtgcctatttagagcaacagatggagaatcttgttgtttgcgttaagtacggtaccaaaattaaggaggaacccccttctgaagcagatccctgtataaagaaagaagaaaatagaagctgtgaatcagagcgcacagaacacagccattccccgggtgacagtagtgcacccatccagaacactgattgctgtcattcaagtgaaagggatggaggtcagaaagggtgcatagaaagcagctcagtatttgatgcagatactctgctctacaggggaactttgaaatgtaatcatagttccaaaaccacttccctagaacagtgtaatatagttcagcctcctcctccttgtaaaatagaaaattccatacctaatcccaatgggactgaaagtgggacttatttcacaagtttccagctgcctttaccaaggatcaaagaatcagaaactaggcagcatagttcagggcaagaaaacactgtaaaaaatccaacccatgtcccaaaagagaattttaggaaacattcacagccccggtcatttgatttgaagacttacaaacctatgggatttgaatcttcatttctgaaatttattcaggaaagtgaagagaaagaagatgattttgatgattgggagccttcagagcacttaacattaagtaattcttcacagtccagtaatgatttaacagggaatgttgtggcaaataatatggtgaatgacagtgaacctgaagttgacatacctcattcttccagtgactctacaattcatgagaacctgactgcaatcccacctttaatagtagctgaaacaacaacagttccttccttggaaaacctgagggttgtattggacaaagcattaacagactgtggagagcttgccttaaaacagcttcattatcttcggccagtggtggttcttgaaagatctaagttttccacaccaattttagacttatttccaacaaaaaagacagatgagctttgtgtaggaagttcataagtagcaattttgttttagtaacagactggctccaacactgcaacatggggacatttgccaactcgaacaaaggctgagaagcagccacaccgttgtttagggtagaataggctgtgtatttacatgaatgtataatatctatgtcagcagtattggctgagtccattagctctccagttggtttaatgattgggtttatttttgtttgtttgtttattaaaaaaatggaactgtacacttgtttggtgctaattaatacatcaaaatatactggggcttcctttttcaaattaagtgtgcatgattgtatatggaacaaatactaaggtcccagggtgggagggctagggaaagggatatggagttcttacttgacttgaatgtgcacctgagggtgctttgtgtaatatattgtacactacagcatcttatattttttgagttgagtttcaataaattacaatttttcacc

SEQ ID NO: 1410 - DNA, 1436 bp, Homo sapiens
cagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtat

SEQ ID NO: 1411 - DNA, 1260 bp, Homo sapiens
cttgtggttcctctctacttggggaaatcaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaaaaaaaaaa

SEQ ID NO: 1412 - DNA, 2388 bp, Homo sapiens
gaaggacggagccgagccgcggctgcctccctcgctcactccctcgcgcactcgcccgccccctccctccctcccctcccttccccgggcccgggtctggccccggcccattcgctgttgggtcttctgctagggaggatgtcgggttcgtcgctgcccagcgccctggccctctcgctgttgctggtctctggctccctcctcccagggccaggcgccgctcagaacgctgggtttgtcaagtcgcccatgtcagaaactaagctcacgggggacgcctttgagctgtactgtgacgtggtcgggagccccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggccagcaacgaccccaagaggaatgacttgaggcaaaacccctccataacatggattcgagcccaggccaccataagcgtccttcagaagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacaggtatatacagcatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaactattgaagtgcaatgatgtataaaaaagtggattcacctgtttttaaaaataaaacattgataaaaaaaaaaaa

SEQ ID NO: 1413 - DNA, 2818 bp, Homo sapiens
ccctactccgcctctcgggatcctttaagaggcggggcttggctgccagctccgcggcccgggcaaaaggctgggactttactccgggtggcggcgaggacgagtctgtgctccatcagctgccgcacccgccgcctcccgcccccaaaccccatccccgcggttgagccacgatgagcggcagagtcggcgatctgagccccaggcagaaggaggcattggccaagtttcgggagaatgtccaggatgtgctgccggccctgccgaatccagatgactattttctcctgcgttggctccgagccagaagcttcgacctgcagaagtcggaggccatgctccggaagcatgtggagttccgaaagcaaaaggacattgacaacatcattagctggcagcctccagaggtgatccaacagtatctgtcagggggtatgtgtggctatgacctggatggctgcccagtctggtacgacataattggacctctggatgccaagggtctgctgttctcagcctccaaacaggacctgctgaggaccaagatgcgggagtgtgagctgcttctgcaagagtgtgcccaccagaccacaaagttggggaggaaggtggagaccatcaccataatttatgactgcgaggggcttggcctcaagcatctctggaagcctgctgtggaggcctatggagagtttctctgcatgtttgaggaaaattatcccgaaacactgaagcgtctttttgttgttaaagcccccaaactgtttcctgtggcctataacctcatcaaacccttcctgagtgaggacactcgtaagaagatcatggtcctgggagcaaattggaaggaggttttactgaaacatatcagccctgaccaggtgcctgtggagtatgggggcaccatgactgaccctgatggaaaccccaagtgcaaatccaagatcaactacgggggtgacatccccaggaagtattatgtgcgagaccaggtgaaacagcagtatgaacacagcgtgcagatttcccgtggctcctcccaccaagtggagtatgagatcctcttccctggctgtgtcctcaggtggcagtttatgtcagatggagcggatgttggttttgggattttcctgaagaccaagatgggagagaggcagcgggcaggggagatgacagaggtgctgcccaaccagaggtacaactcccacctggtccctgaagatgggaccctcacctgcagtgatcctggcatctatgtcctgcggtttgacaacacctacagcttcattcatgccaagaaggtcaatttcactgtggaggtcctgcttccagacaaagcctcagaagagaagatgaaacagctgggggcaggcaccccgaaataacaccttctcctatagcaggcctggccccctcagtgtctccctgtcaatttctaccccttgtagcagtcattttcgcacaaccctgaagcccaaagaaactgggctggaggacagacctcaggagctttcatttcagttaggcagaggaagagcgactgcagtgggtctccgtgtctatcaaatacctaaggagtccccaggagctggctggccatcgtgataggatctgtctgtcctgtaaactgtgccaacttcacctgtccagggacagcgaagctgggggtggcggggggcatgtaccacagggtggcagcagggaaaaaaattagaaaagggtgaaagattgggacttaacacttcagggaagtcagctgccggggagaaacttgctcctaaatgaacacataagtttagatcgcaatgaggagtagcagggtagctggttgctagagttacggtggggatcagaaactcttccaaacattttagcactgaggctggggtagcttttggcttttcccaggtctcaggaggtggcctgagtcagcacacatcttcccactcggtagacaggctggcctctccctcactttgagactttggcaactcctgggccacacggcctgcctctttgattactaatgattgtcagtgactcagagcttcctgggacttcgggtacccacccgctgttctccatgcaaacaaagcgccagggaaatgacccacagggatcgcagctgcagggagggccagggaggttgggggtgggagtgaatgctaaaagcagatcgtccagtgcccttttcagtgctaccggcctctcaccaagcagtcctccatgtgagcaaccccgagacaaaaatgctaagtgggatcaagagagcagcactcggagagggtgtttgccagtctgagtgtcccgcggtgcccgccaacccgcttcctgactgacctgagcaaggtcttactaagcagtcccatctctgtgggaggcatgcaacgcgtgcagggagttcaggtgccggtcggcgtagccaggcctggaggccccccaggcaggaggccgcccaaaggcggggccggcgtctcgcagactaggggctgggggcggccacagacggcctcgaaaccacagcccttaccccaatcccacgagccccgccaacgaaccacaggtgctgggctttagagaacatgggaaggcggccccagacctggcgggaacgcctttccctcagagccaggccccggccccgtctgggaagctcatcttgcgaagctgagggagctcagggcaaaggccaggctagcgcggaccggaaggggccgaggctgcacgggcctctgccagaacgctcaggacatcccggcctgggtttacaacgctgttaggaaaattaaccaatgaataaagcaacgttcagtgcgca

SEQ ID NO: 1414 - DNA, 1731 bp, Homo sapiens
gggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagaggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggccctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaaccttttcatttcctgctctctcccctcttttgtgaagaaagcgggtccagatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtatatgtctgcaatcatggataggaataaaatcgcttatttgagagctttcaaaaaaaaaaaaaaaaaaac

SEQ ID NO: 1415 - DNA, 2718 bp, Homo sapiens
ccgccatggggtccctgttccggagcgagaccatgtgcctggcgcagctcttcctgcagtcgggcacggcctacgagtgcctcagcgccctgggcgagaaaggcctggtccagttccgagacctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggagcagttgcagaagctcgaggttgaactgagagaagtcactaagaacaaggagaaactgaggaaaaacttgctggaactgatagagtacactcacatgctgagagtgacaaagacctttgtgaaacgcaacgttgagtttgaacccacttatgaagaattcccttccttagagagcgattctttgttggattacagctgtatgcagaggctgggagcaaaactgggatttgtgtctggcctaattaaccaaggaaaagtggaagcatttgaaaaaatgttgtggagagtctgcaaagggtacaccatcgtgtcctatgcagaactggatgaatcccttgaagaccctgaaacaggggaagtcataaaatggtatgtctttttaatatccttttggggagagcagattggccacaaggttaagaagatatgtgattgctaccactgccacgtgtacccctatccaaacacagccgaggagcggagggagatccaggaggggctgaacacccgcatccaggatctctacactgtactgcacaaaaccgaggactatttgaggcaagtgctatgtaaagccgccgagtctgtctacagccgtgtgatccaggtgaagaaaatgaaggccatctatcacatgctgaacatgtgcagctttgacgtgaccaacaagtgcctcattgctgaagtctggtgtcccgaggcggatctgcaggacctgcgccgggcactggaggagggctcgagagagagtggtgctacaatcccctcattcatgaatataatccccacaaaagaaacaccccccactcggatccgcaccaacaaattcaccgagggatttcagaacatcgtggatgcttatggagtcggaagctacagagaagtcaatccagctctctttaccatcatcaccttcccgtttttatttgctgtgatgtttggagacttcggacatggctttgtgatgtttttatttgccctcttgtgggtgttaaatgaaaatcatcccagactaaatcagtcacaagagatcatgaggatgttttttaatggccggtacatcctcctgctgatggggctgttctcagtgtacactggcctcatctacaacgactgcttttcaaagtcagtcaacctgttcggctctgggtggaacgtgtcggccatgtacagctccagccacccacccgcagagcataagaagatggtgctttggaacgacagcgtcgttagacacaacagcattttgcagctggatccaagcattcctggagtgttccgaggcccttatccccttggcattgatcctatttggaacttggccacaaatcgcctcacttttctaaactctttcaaaatgaaaatgtccgtgattttaggaatcattcatatgacttttggagtcattctgggaatatttaaccacttgcacttcaggaagaagttcaacatttacctggtttccatcccggaacttctcttcatgctctgtatctttggataccttatatttatgattttctacaagtggctggttttttcagcagaaacctccagagttgctcccagcattctgattgaatttattaacatgtttttattcccagccagtaaaacaagtggcctttacacagggcaggagtatgtccagagagtgctgctggttgtcacagcattgtctgtccctgtcctcttcttgggaaagccactgtttttgttgtggcttcacaatgggcgtagttgcttcggggtgaaccggagtggctacacacttataaggaaagatagtgaggaagaagtttcattgctgggaagccaagatatagaagagggaaatcaccaggtggaagatggatgtagagaaatggcgtgtgaagagtttaattttggagaaatattaatgacccaagtaatccattccatcgagtactgtctgggatgcatctccaacaccgcctcctacctgaggctctgggcgcttagcctggctcacgcacagttgtctgatgtcctgtgggccatgctgatgcgcgtgggcctccgcgttgacaccacctatggcgtcttgctactgctcccggttatcgcgctctttgcagttttgaccattttcatccttctgatcatggaagggctttctgcgtttcttcacgccatacgcctccactgggtagaatttcagaacaaattctacgttggtgcaggcaccaaatttgttcctttctcattcagtctactttcatcaaagttcaataacgacgacagtgtggcatgatcatattgctgtaaccaacaagctttcagatttatggagaatgaccatgttatagactttcacttatgtcagatttatgataggaaaaattccatcttcattactgccttatgacatagccaaataattctgtaagatatac

SEQ ID NO: 1416 - DNA, 831 bp, Homo sapiens
gttgacaagagacattccagcccaccacttcccaagtaaagaattaaaatgcagcatgatggctaaggcaagggcctgcagaagaatgtaaaggagggaggaagagcaggggattcagagcaggaaggaggagacagtactgtctatcccgcagacgtggtgctctttgaagggatcctggccttctactcccaggaaaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagcagtatgctgatgtgatcatccctagaggtgcagataatctggtggccatcaacctcatcgagcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggcgtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagtaataaatacatatatatat

SEQ ID NO: 1417 - DNA, 2116 bp, Homo sapiens
cggttctccaagcacccagcatcctgctagacgcgccgcgcaccgacggaggggacatgggcagagcaatggtggccaggctggggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatgaatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcattggttcattaattctataaggccataaaacaggtaatataaaaagcttccatcgatctatttatatgtacatgagaaggaatccccaggtgttactgtaattcctcaacgtattgtttcgacggcactaatttaatgccgatatactctagatgaatgtttacattgttgagctattgctgttctcttgggaactgaactcactttcctcctgaggctttggatttgacattgcatttgaccttttaggtagtaattgacatgtgccagggcaatgatgaatgagaatctaccccagatccaagcatcctgagcaactcttgattatccatattgagtcaaatggtaggcatttcctatcacctgtttccattcaacaagagcactacattcttttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttagaactcctgacctcaggtgatccacccgcctcggcctcccaaagtgctgggattacaggcttgagcccccgcgcccagccatcaaaatgctttttatttctgcatatgtttgaatactttttacaatttaaaaaaatgatctgttttgaaggcaaaattgcaaatcttgaaattaagaaggcaaaatgtaaaggagtcaaactataaatcaagtatttgggaagtgaagactggaagctaatttgcataaattcacaaacttttatactctttctgtatatacattttttttctttaaaaaacaactatggatcagaatagcaacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgtttgtatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtggttgtgtatttacgctttgattcatagtaacttcttatggaattgatttgcattgaacgacaaactgtaaataaaaagaaacggtg

SEQ ID NO: 1418 - DNA, 3293 bp, Homo sapiens
cgctccctcccctcctagctggcttcggcggggacggcggcggcggcggcggcggcggcggcgggcggggagggcgtgcgccggccgagaggtgtcggcggcgaggcaaaggaagtttcaagtggaaggtcgtccgtcggccggcgcgtcctcctgctctcctccgcagcatcatggcggagccgagcggctcgcccgtgcacgtccagcttccccagcaggcggccccggtgacagcggcggcggcggcggccccggcggccgcgacagcagcgccggccccggcagctcccgcggccccggccccggccccggccccggccccggcggcacaggctgtcggctggcccatctgcagggacgcgtacgagctgcaggaggttatcggcagtggagctactgctgtggttcaggcagccctatgcaaacccaggcaagaacgtgtagcaataaaacggatcaacttggaaaaatgccagaccagtatggatgaactattaaaagaaattcaagccatgagtcagtgcagccatcccaacgtagtgacctattacacctcttttgtggtcaaagatgaactttggctggtcatgaaattactaagtggaggttcaatgttggatatcataaaatacattgtcaaccgaggagaacacaagaatggagttctggaagaggcaataatagcaacaattcttaaagaggttttggaaggcttagactatctacacagaaacggtcagattcacagggatttgaaagctggtaatattcttctgggtgaggatggttcagtacaaatagcagattttggggtaagtgcgttcctagcaacagggggtgatgttacccgaaataaagtaagaaaaacattcgttggcaccccatgttggatggctcctgaagtcatggaacaggtgagaggctatgacttcaaggctgacatgtggagttttggaataactgccattgaattagcaacaggagcagcgccttatcacaaatatcctcccatgaaagtgttaatgttgactttgcaaaatgatccacccactttggaaacaggggtagaggataaagaaatgatgaaaaagtacggcaagtcctttagaaaattactttcactgtgtcttcagaaagatccttccaaaaggcccacagcagcagaacttttaaaatgcaaattcttccagaaagccaagaacagagagtacctgattgagaagctgcttacaagaacaccagacatagcccaaagagccaaaaaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagattgcagtgagtgccagcaccatccccgaacaaatacagtccctctctgtgcacgactctcagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttggcttctggctgtgatgggtcggagattcctgatgaagtgaagctgattgggtttgctcagttgagtgtcagctgatgtatgtcccttgatgtcaccctgatctgtcatgccccaccgccacccctactcccttcaaccctccctctttctgcccatttcctcccaccccctcactcccatttcctagcaaaatcagaagattgtgaagaggccggcttcaacaaaatgggataaaaaaataattttttaaaacttacaacactccgagttctgctttattctctagcaatccacagtacaagaacaagcaaatgccacagctgcacgactgttgctcatttttccaaaagctatttaatattcttagcaatcaatttggatatcccttaagtgaaaagaatctgaaatacactcaggtggtcttatttattggcaacaaaaggaattttctatccagaagcctatttctcctttcattgttgttatttctgttataatactttaaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccccctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccattctattgtttacacaacgattactcgaagatgactgcaaaggtaaaaggaaaataaaagtgtattgcacaatgag

SEQ ID NO: 1419 - DNA, 1074 bp, Homo sapiens
ggtcaggaaagctcaggcaagcccaccctcaggcattacagctagactccgagcttactgggcagtcatctgattcgaccaacatcagttcgcagggcttaagcccagtcccttacggcggctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagggactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattct

SEQ ID NO: 1420 - DNA, 1482 bp, Homo sapiens
attccgaccttctacttccccagaggacgcccgcaggactccgtcaacgtggatgccgtcatcagcaagatcgagagcaccttcgcccggttcccccacgagagggccaccatggatgacatgggcctggtggccaaggcctgcggctgccccctctactggaaggggccgctcttctatggcgccggcggggagcgcacgggctccgtgtccgtccacaagttcgtcgccatgtggagaaaaatcctccagaactgccacgacgacgcggccaagttcgtccatctgctcatgagccccggctgcaactacctggtgcaggaggactttgtccccttcttgcaggacgtggtgaacacgcacccggggctgtcgttcctgaaggaggcgtccgagttccactcgcgctacatcaccacggtcatccagcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacgccctttctaccaagatgatagacaggatcttctcaggagcagtcacacgaggcagaaaagtgcagaaggaagggaagatcagctatgccgactttgtctggtttttgatctctgaggaagacaaaaaaacaccgaccagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaagggaagatcacgctgcaggacctgaagcgctgcaagctggccaacgtcttcttcgacaccttcttcaacatcgagaagtacctcgaccacgagcagaaagagcagatctccctgctcagggacggtgacagcggcggccccgagctctcggactgggagaagtacgcggccgaggagtacgacatcctggtggccgaggagaccgcgggagagccctgggaggacgggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattc

SEQ ID NO: 1421 - DNA, 1278 bp, Homo sapiens
acaggggaaataccgcggcgccggtagttgctgtggtttccgttctgagctcgcagcttaggagctgaagatcgcggacttagcgttgccgcgtccgagtccggccatcagtggctgcagatccggagccaggagctcaaccacccttcttcggaacagggccggcctgctgctgtgccctcgacgctcggtgcctgtatctactccggggcctaggtcggctccgggggcggcttaggagaaggccgccggcgagatgttcaaaaacacgttccagagcggcttcctctccatcctctacagcatcggcagcaagcctctgcaaatctgggacaaaaaggtacggaatggccacatcaaaagaatcactgataatgacatccagtccctggtgctagagattgaagggacaaatgtaagcaccacatatatcacatgccctgcagaccccaagaagacgctgggaattaaacttcctttccttgtcatgattatcaaaaacctgaagaagtattttaccttcgaagtgcaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcagatccatgcaaattgtcgcatccgacgggtttacttctcagacagactctactcagaagatgagctgccggcagagttcaaactgtatctcccagttcagaacaaggcaaagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaaaaaaaaa

SEQ ID NO: 1422 - DNA, 2479 bp, Homo sapiens
  Modified_base 1146: n = a,c,g, or t
ggcacgagggggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccangtgtgtgctttaagcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatttcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgctaaaaaaaaaaaaaaaaaaaaaaaaaaaaaaa

SEQ ID NO: 1423 - DNA, 2391 bp, Homo sapiens
ggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaa

SEQ ID NO: 1424 - DNA, 6303 bp, Homo sapiens
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacggaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccggtgaactgagggacagtgatttcagtaatgaacaattctccaaactacctatgtttataaattcaggactagccatggatggcctgtttgatgacagcgaagatgaaagtgataaactgagctacccttgggatggcacacaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaagatcctgctattactatgagtcaagccactacagacaccgcacgcaccgaaattctcccttgtatgtgagatcacgttcaagatcgccctacagccgtcggcccaggtatgacagctacgaggaatatcagcacgagaggctgaagagggaagaatatcgcagagagtatgagaagcgagagtctgagagggccaagcaaagggagaggcagaggcagaaggcaattgaagagcgccgtgtgatttatgtcggtaaaatcagacctgacacaacacggacagaactgagggaccgttttgaagtttttggtgaaattgaggagtgcacagtaaatctgcgggatgatggagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctagattcaaactcagatgactttgaccctgcttccaccaagagcaagtatgactctctggattttgatagtttactgaaagaagctcagagaagcttgcgcaggtaacatgttccctagctgaggatgacagagggatggcgaatacctcatgggacagcgcgtccttccctaaagactattgcaagtcatacttaggaatttctcctactttacactctctgtacaaaaacaaaacaaaacaacaacaatacaacaagaacaacaacaacaataacaacaatggtttacatgaacacagctgctgaagaggcaagagacagaatgatatccagtaagcacatgtttattcatgggtgtcagctttgcttttcctggagtctcttggtgatggagtgtgcgtgtgtgcatgtatgtgtgtgtgtatgtatgtgtgtggtgtgtgtgcttggtttaggggaagtatgtgtgggtacatgtgaggactgggggcacctgaccagaatgcgcaagggcaaaccatttcaaatggcagcagttccatgaagacacacttaaaacctagaacttcaaaatgttcgtattctattcaaaaggaaaaatatatatatatatatatatatataaattaaaaaggaaagaaaactaacaaccaaccaaccaaccaaccaaccacaaaccaccctaaaatgacagccgctgatgtctgggcatcagcctttgtactctgtttttttaagaaagtgcagaatcaacttgaagcaagctttctctcataacgtaatgattatatgacaatcctgaagaaaccacaggttccatagaactaatatcctgtctctctctctctctctctctctctcttttttttttctttttccttttgccatggaatctgggtgggagaggatactgcgggcaccagaatgctaaagtttcctaacattttgaagtttctgtagttcatccttaatcctgacacccatgtaaatgtccaaaatgttgatcttccactgcaaatttcaaaagccttgtcaatggtcaagcgtgcagcttgttcagcggttctttctgaggagcggacaccgggttacattactaatgagagttgggtagaactctctgagatgtgttcagatagtgtaattgctacattctctgatgtagttaagtatttacagatgttaaatggagtatttttattttatgtatatactatacaacaatgttcttttttgttacagctatgcactgtaaatgcagccttcttttcaaaactgctaaatttttcttaatcaagaatattcaaatgtaattatgaggtgaaacaattattgtacactaacatatttagaagctgaacttactgcttatatatatttgattgtaaaaacaaaaagacagtgtgtgtgtctgttgagtgcaacaagagcaaaatgatgctttccgcacatccatcccttaggtgagcttcaatctaagcatcttgtcaagaaatatcctagtcccctaaaggtattaaccacttctgcgatatttttccacattttcttgtcgcttgtttttctttgaagttttatacactggatttgttaggggaatgaaattttctcatctaaaatttttctagaagatatcatgattttatgtaaagtctctcaatgggtaaccattaagaaatgtttttattttctctatcaacagtagttttgaaactagaagtcaaaaatctttttaaaatgctgttttgttttaatttttgtgattttaatttgatacaaaatgctgaggtaataattatagtatgatttttacaataattaatgtgtgtctgaagactatctttgaagccagtatttctttcccttggcagagtatgacgatggtatttatctgtattttttacagttatgcatcctgtataaatactgatatttcattcctttgtttactaaagagacatatttatcagttgcagatagcctatttattataaattatgagatgatgaaaataataaagccagtggaaattttctacctaggatgcatgacaattgtcaggttggagtgtaagtgcttcatttgggaaattcagcttttgcagaagcagtgtttctacttgcactagcatggcctctgacgtgaccatggtgttgttcttgatgacattgcttctgctaaatttaataaaaacttcagaaaaacctccattttgatcatcaggatttcatctgagtgtggagtccctggaatggaattcagtaacatttggagtgtgtattcaagtttctaaattgagattcgattactgtttggctgacatgacttttctggaagacatgatacacctactactcaattgttcttttcctttctctcgcccaacacgatcttgtaagatggatttcacccccaggccaatgcagctaattttgatagctgcattcatttatcaccagcatattgtgttctgagtgaatccactgtttgtcctgtcggatgcttgcttgattttttggcttcttatttctaagtagatagaaagcaataaaaatactatgaaatgaaagaacttgttcacaggttctgcgttacaacagtaacacatctttaatccgcctaattcttgttgttctgtaggttaaatgcaggtattttaactgtgtgaacgccaaactaaagtttacagtctttctttctgaattttgagtatcttctgttgtagaataataataaaaagactattaagagcaataaattattttaagaaatcgagatttagtaaatcctattatgtgttcaaggaccacatgtgttctctattttgcctttaaatttttgtgaaccaattttaaatacattctcctttttgccctggattgttgacatgagtggaatacttggtttcttttcttacttatcaaaagacagcactacagatatcatattgaggattaatttatcccccctacccccagcctgacaaatattgttaccatgaagatagttttcctcaatggacttcaaattgcatctagaattagtggagcttttgtatcttctgcagacactgtgggtagcccatcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccttcatgccgtggtaagtaccacatctacaattttggtaaccgaactggtgctttagtaatgtggatttttttcttttttaaaagagatgtagcaaaataattcttccagtgcaacaaaatcaattttttgctaaacgactccaagaacaacagttgggctgtcaacattcaaagcagcagagagggaactttgcactattggggtatgatgtttgggtcagttgataaaaggaaaccttttcatgcctttagatgtgagcttccagtaggtaatgattatgtgtcctttcttgatggctgtaatgagaacttcaatcactgtagtctaagacctgatctatagatacctagaatagccatgtactataatgtgatgattctaaatttgtacctatgtgacagacattttcaataatgtgaactgctgatttgatggagctactttaagatttgtaggtgaaagtgtaatactgttggttgaactatgctgaagagggaaagtgagcgattagttgagcccttgccgggccttttttccacctgccaattctacatgtattgttgtggttttattcattgtatgaaaattcctgtgattttttttaaatgtgcagtacacatcagcctcactgagctaataaagggaaacgaatgtttcaaatct

SEQ ID NO: 1425 - DNA, 1635 bp, Homo sapiens
gggggtggcggggacgcgagtggcggccgcggggccccggacaagggtccgcagagctgcagccttcgagggccagccctctccgagtccggggctgggtcccaccagtgacaaggcggcagccccgcgcacaccaaagagaaagcggctgtggcggcagcggcagccccagccatgctgtgttatgtgacgaggccggacgcggtgctgatggaggtggaggtggaggcgaaagccaacggcgaggactgcctcaaccaggtgtgcaggcgactgggaatcatagaagttgactattttggactgcaatttacgggtagcaaaggtgaaagtttatggctaaacctgagaaaccggatctcccagcagatggatgggctagccccttacaggcttaaacttagagtcaagttcttcgtggagcctcatctcatcttacaggagcagactaggcatatctttttcttgcacatcaaggaggccctcttggcaggccacctcttgtgttccccagagcaggcagtggaactcagtgccctcctggcccagaccaagtttggagactacaaccagaacactgccaagtataactatgaggagctctgtgccaaggagctctcctctgccaccttgaacagcattgttgcaaaacataaggagttggaggggaccagccaggcttcagctgaataccaagttttgcagattgtgtcggcaatggaaaactatggcatagaatggcattctgtgcgggatagcgaagggcagagactgctcattggggttggacctgaaggaatctcaatttgtaaagatgactttagcccaattaataggatagcttatcctgtggtgcagatggccacccagtcaggaaagaatgtatatttgacggtcaccaaggaatctgggaacagcatcgtgctcttgtttaaaatgatcagcaccagggcggccagcgggctctaccgagcgataacagagacgcacgcattctacaggtgtgacacagtgaccagcgccgtgatgatgcagtatagccgtgacttgaagggccacttggcatctctgtttctgaatgaaaacattaaccttggcaagaaatatgtctttgatattaaaagaacatcaaaggaggtgtatgaccatgccaggagggctctgtacaatgctggcgttgtggacctcgtttcaagaagcaaccagagcccttcacactcgcctctgaagtcctcagaaagcagcatgaactgcagcagctgcgagggcctcagctgccagcagacccgggtgctgcaggagaagctacgcaagctgaaggaagccatgctgtgcatggtgtgctgcgaggaggagatcaactccaccttctgtccctgtggccacactgtgtgctgtgagagctgcgccgcccagctacagtcatgtcccgtctgcaggtcgcgtgtggagcatgtccagcacgtctatctgccaacgcacaccagtcttctcaatctgactgtaatctaatctgttgtgcttttgttggacttggcatgtttccatgaactgcactattataaactattaaaatgatagatgttggagaaagtaattattccaacacccatctgcccatgcgatgttaaaaaa

SEQ ID NO: 1426 - DNA, 3050 bp, Homo sapiens
taaaggggggtgccagaccaggtgcgtctgccgctggattgtgataggaagcagagtgttcgtgtgaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgtcacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaccaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggcttta

SEQ ID NO: 1427 - DNA, 2336 bp, Homo sapiens
ggcacgaggaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggactattggagaccagctgggggaagcgaaagctagtggtaatctgggaaacaccttaaaagttcttgggaattttgacgaagccatagtttgttgtcagcgacacctagatatttccagagagcttaatgacaaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgaggaaaacctatcattagtgactgctttgggtgaccgagcggcacaaggacgtgcctttggaaatcttggaaacacacattacctccttggcaacttcagggatgcagttatagctcatgagcagcgtctccttattgcaaaagaatttggagataaagcagctgaaagaagagcatatagcaaccttggaaatgcatatatatttcttggtgaatttgaaactgcctcggaatactacaagaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgatagaattggtgaaggaagagcatgttggagcttaggaaatgcatacacagcactaggaaatcatgatcaagcaatgcattttgctgaaaagcacttggaaatttcaagagaggttggggataaaagtggtgaactaacagcacgacttaatctctcagaccttcaaatggttcttggtctgagctacagcacaaataactccataatgtctgaaaatactgaaattgatagcagtttgaatggtgtactccccaagttgggacgccggcatagtatggaaaatatggaacttatgaagttaacaccagaaaaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagaggaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaacatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaaggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaa

SEQ ID NO: 1428 - DNA, 1567 bp, Homo sapiens
aacggcgggcctcacctggacccggggactcttcaacgaggggcgctagcctggcccgactgggcgagtccccgcgtccctgcccgttccgtcgctcagttccacgacacgctcccctgccgccccgcctgttcgcgggtgggtgggcgcttccctcggctccccgtgacactttgcagacgctccccggcgccgggcatgggcgccgccgccgtcggtccccgagccggattccgcgagcggtgcccctgaggccctcggctgctggggtccgcaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagtgccagtgagaggaggcggtagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaaaaaaaaaaaaaaaaaaaaaaa

SEQ ID NO: 1429 - DNA, 2168 bp, Homo sapiens
tccctgtcctgcgcccgcgcgccccgggagcctacccagcacgcgctccgcgcccactggttccctccagccgccgccgtccagccgagtccccactccggagtcgccgctgccgcggggacatggtcctctgcgttcaggggtgagcacccccttgtaagctcagggctactgttgggtgtcagggaacaaagttttagactgctgcgctccaaagcgggcacacacatgtacctagaacacaccagccactgtccccaccatgatgatgacacagccatggacacacccctgcccagacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaaatgcccccaggccgcatgtggcttcattatactgagccatgtgtcagaggatggggagacaggcaggaccttgtctcacctgtgggctgggcccaaacctccactcgcttgcctgccctggccacctgaactgtatgggcactctcagccctggtttttcaatccccagggtcggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcaaaccaaccccacctctatgccctgagccctggtagtccaaagaccccaactctgccctggcttctctggttcttccctgtggaaagcccatcctgagacatcttgctggaaccaaggcaatcctggatgtcctggtactgacccacccctctgtgaatgtgtccactctcttctgcccccagccatatttggggaggatggacaactacaataggtaagaaaatgcagccggagcctcagtccccagcagagcctgtgtctcaccccctcacaggacagagctgtatctgcataaagctggtctcactgtggcgcaggccccggggggagtgcctgtgctgtcaggaaaagggggtgctggtttgagggccaccactgcagttctgctaggtctgcttcctgcccaggaaggtgcctgcacatgaaaggagagaaatacacgtctgataagacttcatgaaataataattatagcaaagaacagtttggtggtcttttctcttccactgatttttctgtaatgaacattatacctttattacctctttattttattacctctataataaaatgatacctt

SEQ ID NO: 1430 - DNA, 1347 bp, Homo sapiens
gcgcggcactggtcctccgccggcctcgcccacccctcggccccgagatgaagaaggacgagtcgttcctgggcaagctgggcgtgaccctggccaggaagcggagggcgcgcgaggtgagtgacctgcaggaagaaggcaagaatgcatcaactcaccgatgtcccccgccctggaatggttcaccctgaagacacccagctcgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaacagtacatgacctgctgcggcccgaggctgggcgctccggtggagtgggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggttcgagcgggatgccttcgacacgctgttcgaccacgccccggataagctcagcgtggtgaagaagtctctcatcacttttgtgaacaagcacctgaacaagctgaatttggaggtgacggaactggagacccagtttgcagatggcgtgtacctggttctgctcatgggccttctggaagactactttgttcctctccaccacttctacctgactccggaaagcttcgatcagaaggtccacaatgtgtccttcgcctttgagctgatgctgggacggaggccttcaagaaacccaaggctcgtcctgaagacgtggttaacttgggacctcaaatcccccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttttggtccaagctgtgttgactgtcatccccaccccacccctacctcacgcctgccccaccccctgcctcttttggttgttgtttttaatctcctctccatgtagttcccagtgggcaagagcctttgaaaatgcaggattttaaacaaaaaaa

SEQ ID NO: 1431 - DNA, 3561 bp, Homo sapiens
gcagtggaacgcgctgggccgcgggcagcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagttagggatctctcctattgtcacgtctggccttataatgcaactcttggctggcgccaagataattgaagttggtgacaccccaaaagaccgagctctcttcaacggagcccaaaagttatttggcatgatcattactatcggccagtctatcgtgtatgtgatgaccgggatgtatggggacccttctgaaatgggtgctggaatttgcctgctaatcaccattcagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggaatggaatttgaaggtgctatcatcgcacttttccatctgctggccacacgcacagacaaggtccgagcccttcgggaggcgttctaccgccagaatcttcccaacctcatgaatctcatcgccaccatctttgtctttgcagtggtcatctatttccagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttgcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggtaaaaaaaaaaaaaaaaaaaaa

SEQ ID NO: 1432 - DNA, 1960 bp, Homo sapiens
tcggcacgagcagcggccggcgggcggcggggatacttctacatagacataatcaagttttgactatttggaaaccaagcatcattaaaattctctcaaactgctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtgctggtaaaccgcctatgtttggtgattatgaagctcagagacactggcaagaaataacttttaatttaccggtcaaacaatggtattttaacagcagtgataacaatttacagtattggggattggattacccacctcttacagcttatcatagtctcctatgtgcatatgtggcaaagtttataaatccagactggattgctctccatacatcacgtggatatgagagtcaggcacataagctcttcatgcgtacaacagttttaattgctgatctgctgatttacatacctgcagtggttttgtactgttgttgcttaaaagaaatctcaactaagaaaaagattgctaatgcattatgcatcttgctgtatccaggccttattcttatagactatggacattttcaatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtttgtgttgctagttaagctagcttgtattgttgtggcttccttcgttctctgctggctgccattctttacagaaagggaacaaaccctgcaggttctaagaagactcttcccggttgatcgtggattatttgaggataaagtagccaatatttggtgcagcttcaatgtctttctgaagattaaggatattttgccacgtcacatccaattaataatgagcttttgttttacgtttttgagcctgcttcctgcatgcataaaattaatacttcagccctcttccaaaggattcaaatttacactggttagctgtgcgctatcattctttttattttctttccaagtacatgaaaaatccattctcttggtgtcactaccagtctgcttagttttaagtgaaattccttttatgtctacttggtttttacttgtgtcaacatttagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttgtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctacacaaaataaatgtatatggagaccaaaaaaaaaaaaaaaaaaaa

SEQ ID NO: 1433 - DNA, 1774 bp, Homo sapiens
cgtggggtgcaaaccccgagcgtctacgctgccatgaggggcgcgaacgcctgggcgccactctgcctgctgctggctgccgccacccagctctcgcggcagcagtccccagagagacctgttttcacatgtggtggcattcttactggagagtctggatttattggcagtgaaggttttcctggagtgtaccctccaaatagcaaatgtacttggaaaatcacagttcccgaaggaaaagtagtcgttctcaatttccgattcatagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgagaagtttgatgtggagcgagataactactgccgatatgattatgtggctgtgtttaatggcggggaagtcaacgatgctagaagaattggaaagtattgtggtgatagtccacctgcgccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctcccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggaaaaaaaaaaaaaaaaaaaagatctttaattaa

SEQ ID NO: 1434 - DNA, 4049 bp, Homo sapiens
gcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacckcagaggctgaaattcctaatacctttcctttatcgtggttatagtcagctcatttccattccactatttcccataatgcttctgagagccactaacttgattgataaagatcctgcctctgctgagtgtacctgacagtaagtctaaagatgaragagtttagggactactctgttttagcaagaratattktgggggtctttttgttttaactattgtcaggagattgggctaragagaagacgacgagagtaaggaaataaagggrattgcctctggctagagagtaagttaggtgttaatacctggtagaaatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaatggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttcaaaaaaaaa

SEQ ID NO: 1435 - DNA, 548 bp, Homo sapiens
gccttgcagaacttctacttgcctgcctccctgcctctggccatggcctgccggtgcctcagcttccttctgatggggaccttcctgtcagtttcccagacagtcctggcccagctggatgcactgctggtcttcccaggccaagtggctcaactctcctgcacgctcagcccccagcacgtcaccatcagggactacggtgtgtcctggtaccagcagcgggcaggcagtgcccctcgatatctcctctactaccgctcggaggaggatcaccaccggcctgctgacatccccgatcgattctcggcagccaaggatgaggcccacaatgcctgtgtcctcaccattagtcccgtgcagcctgaagacgacgcggattactactgctctgttggctacggctttagtccctaggggtggggtgtgagatgggtgcctcccctctgcctcccatttctgcccctgaccttgggtcccttttaaactttctctgagccttgcttcccctctgtaaaatgggttaataatattcaacatgtcaacaaaaa

SEQ ID NO: 1436 - DNA, 1646 bp, Homo sapiens
ctggcttctcggaactttttcagaagactgcgcctgtcctggttgcggcatggctgtcactgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagtaacagagagctcagagggggagaaggctgcagctgggggaggagcaaagagccggcccctagccaatggccaccccatcctcaataacaaccatcgtaagaatgactgactgaaccattattccagctggctcccagattaatgcataaagccaaggaactaccccgctccctgcgctatagggtcactttagctctggggaaaaaggagaaaggagaggagagttctctgcatcctccctccttgcttgtcacccagttgcctttaaaccaaattctaaccagcctatccccaggtaggggacgttggttatattctgttagagggggaccggtcgtattttcctccctacccgccaagtcatcctttctactgcttttgagggcctccctcaagctctctgtgggtaggggttacaattcacattcctttattctgagaatttggccccagcagtttgcctttgactccctgaactccaaagcaagggttggtgccttaaggtcccatctgtggggcctcattctggcaaagctggaccaaggctaacctttctaacctccctaaattgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaaaaaaaaaaaaaa

SEQ ID NO: 1437 - DNA, 3221 bp, Homo sapiens
tgtcaaaagcctgcacacgagacccccgtgggccaggactgacttcctccccacacagggctgggcggggcaagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcaggcagttcctgtggagcttccggctgccgggcgaggcccagaagatagaccggatgatggaggcctttgccactcgatactgcctctgcaacccaggcgtcttccagtccacagacacctgctacgtgttgtccttctccatcatcatgctcaacaccagcctccacaatcccaacgtccgggacaggccgcctttcgagcgctttgtgtccatgaaccgcggcatcaacaatggtagcgacctgcccgaggaccagctgcggaacctcttcgacagcatcaagagtgagccattctccatccctgaggacgacggcaatgacctcactcacaccttcttcaatccagaccgggagggttggctgctcaagctagggggccgcgtgaagacgtggaaacggcgctggttcatcctgaccgacaactgcctctactacttcgagttcaccactgacaaggagccacggggaattatacctcttgagaacctctcggtgcagaaggtggatgaccccaagaagccattctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccgagccagcatcacccgtgtccccttctacgacctggtctctactcggaagaagaagattgccagcaagcagtgagattcctggaggtggcactgggggctggtcaccctgagagtcccatcgcctgcagcacctggagacccacctcccaccccagtgcactcttttgggccacagacatcattgctgttccccgttacctcgagctgactctagaggggaaggcagagctcaggagggtgggtgggagctgcagtgggctcagagtccagcaatgaggccccctggcctgggcacccagctgcaggcccctgccctacgtgcactacaggaaggggtgaggagagcagccagaggaaaaccagccccagaatgctgcaacttctcttctctctggacttcggtgtcctcggctctgaaggcgctctctgcacttagatgctgtcagccctcaacgtaggaggggccgtggggtccctaagtgattcttctccctggcaaggctcttccttttcagggatatctctgccaacccttcccctgtcctcgggttgggcttggccctctctgcctgagagagctcagcacacacacagctcagacccacggacaggaccccgggacagaaccccgggagcactgccctaggagcctggaccccacgagctcagtcccagctctgcctctgactcgctgtgtaccctctgccaagtcatgcccattctctagttcttgcaaaactgcagtgtttggactagaaacgtattggcccctgctagccctgtgctccagcttccagctggagatggcagccgttatttgcggagcccaggctgactccggattcaacgttgctggggagagaaaagcagtatagactccaccttccaggatgtccatttcggggagaggagcaggtgggaccctcaagaaaatgacggagaacatcccagacagatgggactcaagcaggatgggtgctatatccaagaagccaagaagggagagtttcgtgcactgtggttaacaggagggccgcctggaggcagtggctgagccagaaagtaacacagagctcatgcttggagagatagagtcttggccatggctttcctgcaagaccactgacgagcagtcccatggtgataaagggcagcccggcgggtcccagcatctcgagaccctctgcagaagtattatcagagtagagctgacttccagtacccgggcagccagctctgtctccagggaggcctggcctggaggaggagtccactaacaggaaacacttctcaccccctcacacaggcccaggggagcccctggagggaaattccttggcaggggaacaggaaatgtggtcgcctctgccccactgccagcctgagtgggcaaggaagcaggtggatcccccagaaggaaccgcagctcgcgaggcacctctcctcgtccccacccacccccacatttgcacaccttccacagggtcaggatggagtagctgccttgcgaggtggtgagactcctgtctctggaggtctgcaagcactggtagtgatattgcagcagacaaggtctgggttgggcgtctgcaggaggagaccttgtgggacatctgaggacatccgcagattcttgtcagcctgtgaactaggccctgcctctgtcacctcattggtccatgaaggagcagccaggggtggtggaaggagcactgggctaggggtcaggggtcagagattctgtcctgctcctgggatgcactggctactcccttagtctactcccttcccctctctggtcctcagcttcctccatcatggaggagatgggatcatggattttctgggcataagtggctgttctgggagtcattccaaagagagaataaaactcctgatccaaaaaaaaaaaaaaaaaaaaa

SEQ ID NO: 1438 - DNA, 1210 bp, Homo sapiens
ctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttaaaaaaaaaaaaaaaaaaaaaaaaaa

SEQ ID NO: 1439 - DNA, 3078 bp, Homo sapiens
ctcctcctccgtctcctcctctctctctcatctgctgtggttatggcctgtcgctggagcacaaaagagtctccgcggtggaggtctgcgttgctcttgcttttcctcgctggggtgtacggaaatggtgctcttgcagaacattctgaaaatgtgcatatttcaggagtgtcaactgcttgtggagagactccagagcaaatacgagcaccaagtggcataatcacaagcccaggctggccttctgaatatcctgcaaaaatcaactgtagctggttcataagggcaaacccaggcgaaatcattactataagttttcaggattttgatattcaaggatccagaaggtgcaatttggactggttgacaatagaaacatacaagaatattgaaagttacagagcttgtggttccacaattccacctccgtatatctcttcacaagaccacatctggattaggtttcattcggatgacaacatctctagaaagggtttcagactggcatatttttcagggaaatctgaggaaccaaattgtgcttgtgatcagtttcgttgtggtaatggaaagtgtataccagaagcctggaaatgcaataacatggatgaatgtggagatagttccgatgaagagatctgtgccaaagaagcaaatcctccaactgctgctgcttttcaaccctgtgcttacaaccagttccagtgtttatcccgttttaccaaagtttacacttgcctccccgaatctttaaaatgtgatgggaacattgactgccttgacctaggagatgagatagactgtgatgtgccaacatgtgggcaatggctaaaatatttttatggtacttttaattctcccaattatccagacttttatcctcctggaagcaattgcacctggttaatagacactggtgatcaccgtaaagtcattttacgcttcactgactttaaacttgatggtactggttatggtgattatgtcaaaatatatgatggattagaggagaatccacacaagcttttgcgtgtgttgacagcttttgattctcatgcacctcttacagttgtttcttcttctggacagataagggtacatttttgtgctgataaagtgaatgctgcaaggggatttaatgctacttaccaagtagatgggttctgtttgccatgggaaataccctgtggaggtaactgggggtgttatactgagcagcagcgttgtgatgggtattggcattgcccaaatggaagggatgaaaccaattgtaccatgtgccagaaggaagaatttccatgttcccgaaatggtgtctgttatcctcgttctgatcgctgcaactaccagaatcattgcccaaatggctcagatgaaaaaaactgctttttttgccaaccaggaaatttccattgtaaaaacaatcgttgtgtgtttgaaagttgggtgtgtgattctcaagatgactgtggtgatggcagcgatgaagaaaattgcccagtaatcgtgcctacaagagtcatcactgctgccgtcatagggagcctcatctgtggcctgttactcgtcatagcattgggatgtacttgtaagctttattctctgagaatgtttgaaagaagatcatttgaaacacagttgtcaagagtggaagcagaattgttaagaagagaagctcctccctcgtatggacaattgattgctcagggtttaattccaccagttgaagattttcctgtttgttcacctaatcaggcttctgttttggaaaatctgaggctagcggtacgatctcagcttggatttacttcagtcaggcttcctatggcaggcagatcaagcaacatttggaaccgtatttttaattttgcaagatcacgtcattctgggtcattggctttggtctcagcagatggagatgaggttgtccctagtcagagtaccagtagagaacctgagagaaatcatactcacagaagtttgttttccgtggagtctgatgatacagacacagaaaatgagagaagagatatggcaggagcatctggtggggttgcagctcctttgcctcaaaaagtccctcccacaacggcagtggaagcgacagtaggagcatgtgcaagttcctcaactcagagtacccgaggtggtcatgcagataatggaagggatgtgacaagtgtggaacccccaagtgtgagtccagcacgtcaccagcttacaagtgcactcagtcgtatgactcaggggctacgctgggtacgttttacattaggacgatcaagttccctaagtcagaaccagagtcctttgagacaacttgataatggggtaagtggaagagaagatgatgatgatgttgaaatgctaattccaatttctgatggatcttcagactttgatgtgaatgactgctccagacctcttcttgatcttgcctcagatcaaggacaagggcttagacaaccatataatgcaacaaatcctggagtaaggccaagtaatcgagatggcccctgtgagcgctgtggtattgtccacactgcccagataccagacacttgcttagaagtaacactgaaaaacgaaacgagtgatgatgaggctttgttactttgttaggtacgaatcacataagggagattgtatacaagttggagcaatatccatttattattttgtaactttacagttaaactagttttagtttaaaaagaaaaaatgcagggtgatttcttattattatatgttagcctgcatggttaaattcgacaacttgtaactctatgaacttagagtttactattttagcagctaaaaatgcatcacatattgcatattgttcaataatggtcctttcatttgtttctgattgttttcatcctgatactgtagttcactgtagaaatgtggctgctgaaactcatttgattgtcatttttatctatcctatgttaaatggtttgtttttacaaaataataccttattttaattgaaacgtttatgcttttgccaagcacatcttgtaacttaatatagctagatgttaaggttgttaatgtaccaaaaaaaaaaaa

SEQ ID NO: 1440 - DNA, 6837 bp, Homo sapiens
ggcacgagcttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagggagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcaggttggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcacctttaaaaaaaaaaaaaaaaaaaaaa

SEQ ID NO: 1441 - DNA, 4318 bp, Homo sapiens
aagcggctcgggctgcggctggctcagagtgccgcggggggcgtggggcggtgctgaggagctgaagccgtggccagctcgactccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaggtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaggagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattctttctggtgattctgaaccttgcctcatagcttaaagtataaaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttctttgtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattggtacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcaaaaaaaaaaaaaaaaaaaaaaaaaaaa

SEQ ID NO: 1442 - DNA, 3970 bp, Homo sapiens
ggcttaggaagtattaactgatctctgccctagttctcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggtcagctcaccgacgagcaggtcatcgagaacgcgggggagttcttccgggaccagggccggcagtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaaaaaaaaaaaaaa

SEQ ID NO: 1443 - DNA, 4006 bp, Homo sapiens
ccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttgaacaacatgttctaccgtggatttgtacttgctccttttgctctttttgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcatggtggtgggcgcctgtaatcccagttactcgggaggctgaggcaggagaatcacttgaacccgggaggcagaggttgcggtgagccaagagcgcaccattgcactccagccttgggcgacaaaaacgaaactccatcttcaaaacaaaacaaaacaaaacaaacaaacaaacaaaacttgcatcttaaccaaaagtcttggttttatcttaatccattaaaagttggtcttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatatgcacacatatataggcagttgcatgcctagcatgggtattttataaccatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaatgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattctt

SEQ ID NO: 1444 - DNA, 1163 bp, Homo sapiens
gcacgaggcagcatggcggacgcagctcctcaactaggcaagaggaagcgcgaattggacgtggaggaggcccacgccgccagcacagaggaaaaggaggcaggagttggaaatggtacctgtgctcctgtccgcttaccgttctccggcttcagactgcagaaggtgctgagggagtctgcgcgggacaaaatcattttcctacacgggaaggtgaatgaggcctctggggatggggatggagaggatgccgttgtgatcctggagaagacgccatttcaggtggaacaggtggctcagctcctgacgggcagccctgagctccaattgcagttctccaatgatatctacagcacctatcacttgttccctccaagacaactgaatgatgtaaagacgaccgtggtttaccctgccacagagaaacacctgcagaagtacctgcgccaggacctccgcctgatccgagagacgggagatgactacaggaatattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcaa

SEQ ID NO: 1445 - DNA, 761 bp, Homo sapiens
atccccacccaaagcctgatggaccccggctggccatgctgtcccctccctgtggcgtttcttagcagatggctgcagagcttcgttgatggtcttttctgtactggaggcctcctgaggcagcgaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctccactcacaggatcctgagctgcacttacctgtgagagtcttcaaacttttaaaccttgccagtcaggacttttgctattgcaaatagaaaacccaactcaacctgcttaagcagaaaataaatttattgattcaagtttggagaaaaaaaaaaaaaaaaaaaaaaaaaaaa

SEQ ID NO: 1446 - DNA, 2400 bp, Homo sapiens
tggtggtgcctgtctcgctgctcctgatgctggttactctcttctctgcctggcactggtgcccctgctcagggaaaaagaaaaaggatgtccatgctgacagagtgggtccagagacagagaacccccttgtgcaggatctgccataaaggacaatatgaactgatgcctggactatcagtaaccccactgcacaggcacacgatgctctgggacataactggtgcctggaaatcaccatggtcctcatatctcccatgggaatcctgtcctgcctcgaaggagcagcctgggcagccatcacaccacgaggacaggaagcaccagcacgtttcacacctcccccttccctctcccatcttctcatatcctggctcttctctgggcaagatgagccaagcagaacattccatccaggacactggaagttctccaggatccagatccatggggacattaatagtccaaggcattccctcccccaccactattcataaagtattaaccaactggcaccaaggaattgcctccagcctgagtcctaggctctaaaagatattacatatttgaactaatagaggaactctgagtcacccatgccagcatcagcttcagccccagaccctgcagtttgagatctgatgcttcctgagggccaaggcattgctgtaagaaaaggtctagaaataggtgaaagtgagaggtgggggacaggggtttctctttctggcctaaggactttcaggtaatcagagttcatgggccctcaaaggtaaattgcagttgtagacaccgaggatggttgacaacccatggttgagatgggcaccgttttgcaggaaacaccatattaatagacatcctcaccatctccatccgctctcacgcctcctgcaggatctgggagtgagggtggagagtctttcctcacgctccagcacagtggccaggaaaagaaatactgaatttgccccagccaacaggacgttcttgcacaacttcaagaaaagcagctcagctcaggatgagtcttcctgcctgaaactgagagagtgaagaaccataaaacgctatgcagaaggaacattatggagagaaagggtactgaggcactctagaatctgccacattcattttcaaatgcaaatgcagaagacttaccttagttcaaggggaggggacaaagaccccacagcccaacagcaggactgtagaggtcactctgactccatcaaactttttattgtggccatcttaggaaaatacattctgcccctgaatgattctgtctagaaaagctctggagtattgatcactactggaaaaacacttaaggagctaaacttaccttcggggattattagctgataaggttcacagtttctctcacccaggtgtaactggattttttctggggcctcaatccagtcttgataacagcgaggaaagaggtattgaagaaacaggggtgggtttgaagtactattttccccagggtggcttcaatctccccacctaggatgtcagccctgtccaaggaccttccctcttctcccccagttccctgggcaatcacttcaccttggacaaaggatcagcacagctggcctccagatccacatcaccactcttccactcgattgttcccagatcctccctgcctggcctgctcagaggttccctgttggtaacctggctttatcaaattctcatccctttcccacacccacttctctcctatcaccttcccccaagattacctgaacagggtccatggccactcaacctgtcagcttgcaccatccccacctgccacctacagtcaggccacatgcctggtcactgaatcatgcaaaactggcctcagtccctaaaaatgatgtggaaaggaaagcccaggatctgacaatgagccctggtggatttgtggggaaaaaatacacagcactccccacctttctttcgttcatctccagggccccacctcagatcaaagcagctctggatgagatgggacctgcagctctccctccacaaggtgactcttagcaacctcatttcgacagtggtttgtagcgtggtgcaccagggccttgttgaacagatccacactgctctaataaagttcccatccttaatgactcacttgtcaactagtggactaattaaccctccaccaaaaaaacacaaagtgcttctgtgagaccaattttgtgctaatgagcattgagactgatgctttgtaagtcacaccacaacaaatattgattgagggcgctgcatgtgctgggtacatttcttggcacttgggaatcagtagtcaagcgaaacccttgcctttgagagtttatggtctggataatataaataaacaagtaagcataaaaaaaaaaaaaaaaa

SEQ ID NO: 1447 - DNA, 1733 bp, Homo sapiens
ctctcacgcagccaacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaaggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagaaaaggtgaagagcgagttcccgcaggcaaattggatgggcgtctggccgccgtggagttccggtgacccatttccccagccgtgtcgtctccaggaccacccgatggaaataacaggcgggcttcacggtgcggctctgtccgcccatgccccgctgggtctgcagggaactggactgtcccatggcctgtgagcaccggagcgcctggctgcctgccaaggaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactaccaaaaaaaaaaaaaaaaaa

SEQ ID NO: 1448 - DNA, 3115 bp, Homo sapiens
  Modified_base 10: n = a,c,g, or t
cgcttttttnttttttttttttttttttgagacggagtcttgcactgttgcccaggctggagacagtggtgtgatcttggctcactgcagtctccacctctcaaattcaagtgattctcctgcctcagcctcccaagtagctgggattataggtgcccgccaccctgcctggctaatttttgtatttttagtaaagatggggttttgtaacattggccaggctggtctcaaactcctgacctcaactgaactgcccccatcgggcttccaaagtgttgggattagaggtctgagctactgggcccgggcaaacttggaaacatttttttccttcctagtgcctcagttttctcaaatgtaaaatgggaataaaatatctaccttgtaagacttttgtgagggtctaataactgttatatacattatctcatttaatcttcacaacaacctttaaaatagggatacgatcattctcaatttacagttgagtgaaagtgaggcagttcagatggcttgactaaggttacctggcatttgagtggcagagccaagatttaaacccagctctgtctgatgctagaccctttgcttcaaccatattctgtaatgtctcatttctaggaatgaatgaaggaatgttcacacatgtatcatccagcctctgaggtgcctctgacaaccataattgcctcctcatgaaaccgagcccagttcctcctgtggctcttcctgctgcagccgtgggccttgctctcctggctggaagcgctgttttcatcttatctggggattctcattgctgacggtgctggaggctgtggggcacagtggtttcaagcacaggctttggagtcaggcaaacctgggtttcaatatggctcaggaagctgttgggcaggaggacttttggtgagcaggcactgtctgataatggtgtttcccaggatcccaggtttcttgggggcacacaagtaggccaaagatgatctgggaacctcccagagaattgcctcatactgtactctccccaagaggctgcagccaagagaataggggccacgtcacgggggctcatgatggagtctgggctttgtgggaaaggaagtggggagggtctcagaaatgtttttacaatgtaaaatcttccagttagaactttatatgcaggatttaatcagaaggaaatttggacaggactcatttttctcattgctgctctaagtggctgctctaagcagtctggactgtctcccctgtggctttgttgagttcagtaaacatttattgtgcacatactgtgtgcaggcactttgctggggatacagggatgaaatagggacagtgcccatgcctgagggcattgccctgaagctggatgctaaggccatctgtgtgtgtgtctgtgtgtctgcatgtatctctgtgtctgcgtgtgtctctgtgtctgtgcttctgtgtctatgtgtatgtctgtgtgagtgtctgtgggtctctttttttgtgtttgtgtgtgtatctgtgtgtgtgttctctgtgtgcctgtatgtgtctttgatgtgtgtttctgtatgtgtctctgtgtgtgtctatatgtgtgtatctgtgtctatgtatgtgtgtgtcattttgtttgtttctgggtgtgtctacctctgcgtgtctctgtatacctgtatctccgtgtgtgtgtctgtgtgtgtgtatttgtgtgtctctgtatgtgcgtccgtgggtgtgtgtctgtgtgtgtgtgtgtgtgtattgagagggagggagaaagaaagggagcgacagatgggtcagcatggaaggtgtatcctcattcacagccctgggaggaatcagtcaatccacctactggtcaagaccaactctggtggtgcctggctgacagtgggaatgtgacttttcatttaagaatgggtttgcatttcctaggaaaagaatgtaggagttggagtctcaaggagtgttttttttttccttttgtgattgagagagcacagccttgtgtgcattggctgacagttaccaatctgcgtgttggggatagccacagagaagagacagagggaaccgcagacagtgagcaggagtctggtggaaccagtctgcctttaggcccaaacccccaactatgaatacctcaccttagggagctcagtcttttgtttgttcataaaaaaccaatctgggaaccagaggtggacaggaaagaggaggctgacctgctgctcccaggttaatgtgatcttggctggtgttgacaagtgtattatggttcatagcatagcacaaacccttagagattccccttgccctcaccggggtcaccacaccaaaccaggtatcttcaggagtgaggaccacaaaaaattggagatctcaccagggtgggcagagatttctttgttaaagtctgaaggagagaagactcaggggcatctctctggctccaaatctctgaagggccaaaggcagaagtgctgggggagtgtcaagttttcatttacaacagggacagcctgacagtggctgccttatgtggcagtgagtttcagtcaacagtcaacagaggcccaacgactactcaccaatgggaccaggtggccatagagggctggggagggcagagcaaggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaacctatcacctagcagataaaactatggggaaaacttaaatctgtgcatacatttctggatgcatttacttatcttcaaaaaaaaaaaaaaaaaaaaaaaaaaaaaaaaa

SEQ ID NO: 1449 - DNA, 839 bp, Homo sapiens
tactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtatagtccttcaataggaaattgtaattaaaatataattttatagaaccatttttatgtaatctgatttgaatgttatagttgataataataaaatcacttacttggttgactaaaa

SEQ ID NO: 1450 - DNA, 1521 bp, Homo sapiens
gaaaaaaatgcaatacaagaagcaagaccaaacagatatctaaacactacaaccacttctactacgaaaggccaaaacagcagacttgattgtgacatcaggtgacctagtaatcagctgtgtattctagctggtgcctctaccagcttcccatgtgaccttgaacatgtcattgaatgctcgctaggcctctgtttctttatctgtgaaatgggcttgatattcctcctctaccccaaccgatagtgcagaatgaaaagtaactgaaagtccttcctccagggcaccatagtgtctgggtgaaaagtagaatataaactcggtagacttctggtcccttcattggtcatggaatggaccagtgcttgcttcattgagcaacagttctgttgttcagaattcctggatttcacctcacttctgctctccctgcaggtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacacaataaagacacacaaggacgtctgcgcagcaagaaaagaatctcagttgccaagcagattgatatcacacagactcaaagcaaaggcatgtggaacttctatatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1451 - DNA, 1934 bp, Homo sapiens
ctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaata

SEQ ID NO: 1452 - DNA, 10011 bp, Homo sapiens
ttcctccgcgaaggctcctttgatattaatagtgttggtgtcttgaaactgacgtaatgcgcggagactgaggtcctgacaagcgataacatttctgataaagacccgatcttactgcaatctctagcgtcctcttttttggtgctgctggtttctccagacctcgcgtcctctcgattgctctctcgccttcctatttcttttttttttttttaaacaaaaaacaacaccccctcccctctcccacccggcaccgggcacatccttgctctatttcctttctctttctctctctctctctctcttttttaataagggtgggggagggaaaggggggggaggcaggaaagacctttttctctcccccccgcaataatccaagatcaactctgcaaacaacagaagacggttcatggctttggccgccgcgccaccatctttcgggctgccgagggtgttcttgacgattaatcaacagatgtacagatcagctctcaaaatgtcttctgtgtcttctgagcgtcttctaagacaattgcattagcctcctgctagttgactaatagaattaataattgtaaaaagcactctaaagccacatgccttatgaagtcaatgctgggtatgattttacaaatatggtccggaaaaagaacccccctctgagaaacgttgcaagtgaaggcgagggccagatcctggagcctataggtacagaaagcaaggtatctggaaagaacaaagaattctctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatttccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccttaatccagagttaaatgataagctttccaggggctctgtcattaatcagaatgatctagccaaaagttcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggactggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtgatttcattttagccaggtatttctttcttgtgtgtgatgaaccagtatggatttgcttttctaagcctcctgttggttactaatctcacttggcacattataactaaaggaatcccctcaattcaaaagcatagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacggagatgtagaagatattacaagctactggatgcactgtcagattaacttatttcattaaagaagttgggagaacaaataggaaaaaaaaaacttatttttctagtaaatattaatgtattacatttcaaataatggtgcctgacatattgaataattattttctacagtgtacgtatgcaacaaagatattccatcatgcattagagtcagttctggctctgcctagctgtttacatttgcaaatgtagcaaacaaggtaatgaagcaactatttctattgcagtagatatccttttgtgtgtgtgtgtgtgcattaaagttgtaaacggtaacatgaaacaaatgaaagttcttgctataatggtatggaaaacaagaaggaaatgaaaatatttttatgcctacttaggaaaaaaagggtagcacttattcattccaagtacttttttttttttaatttttaagctcttaactcacattgttatgcttaagatgataaacatatatcctctttttattgctttgtctatgtttcatatgaaacatttcagaaattattttgataagtgttgctggaatctgcaacgctgatttttttttgcattctgtagtcgcatttgcactccatttttacattaattcgcagttgctttgtatcattgttttgtttgggttttgtttctttttcacagtgccgggtcttcgtttcttaaagttggatggcaggtagagttcaaccagttcgtgactgttgtagcgaatgaagttaaaaaaatgtctttctgatgttgtgttgtcattttcatttttgcatttttttgtttgcatattaaaaaaagagaaaagagaaagcaagagacagaaatcaggactaagtcctctgcttcagtttcattgttaacgggccttattctgatctcacctgtcgcgtagctctaatattcacataaactgaaataaagaagtggaatgaggagctttgacattcaaattatgtgatgtaatttatcttccttaggaattttgatggatgcatctcaaaatgtatagccagacttgagaggtgacaattaaagatctaaaaaagagaggagattcccccaaacaacaatatttaattttcttagtaaaaagaataacagaatgcatcgtggcaatccttaagcaacattatctatgtggactgcttaaatcagcaaaacaccagaagtttggttaacttgggcaatatgacaagtattactttttgggcaaaactactcattaagcaatttctctagtgtgtcggacacaaataggttctttatttttggcatgtatgcctttttattttcattcaattttttttttttctcagacagacatagtagtatcaactagcattggaaaatacatatcactattcttggaatatttatggtcagtctactttttagtaaaatatttttggatagcgttgacacgatagatcttattccatacttctttattattgataattttattttcattttttgctttcattattatacatattttggtggagaagaggttgggcttttttgaaagagacaaaaatttattataacactaaacactccttttttgacatattaaagcctttattccatctctcaagatatattataaaatttatttttttaatttaagatttctgaattattttatcttaaattgtgattttaaacgagctattatggtacggaactttttttaatgaggaatttcatgatgatttaggaattttctctcttggaaaaggcttcccctgtgatgaaaatgatgtgccagctaaaattgtgtgccatttaaaaactgaaaatattttaaaattatttgtctatattctaaattgagctttggatcaaactttaggccaggaccagctcatgcgttctcattcttccttttctcactctttctctcatcactcacctctgtattcattctgttgtttgggatagaaaaatcataaagagccaacccatctcagaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacattatgtttataattgcacatgtgcacataatctattatgatccaatgcaaatacagctccaaaaatattaaatgtatatatattttaaaatgcctgaggaaatacatttttcttaataaactgaagagtctcagtatggctattaaaataattattagcctcctgttgtgtggctgcaaaacatcacaaagtgaccggtcttgagacctgtgaactgctgccctgtttagtaaataaaattaatgcatttctagagggggaatatctgccatccagtggtggaaatgtggagtaaagaagctggtggtctgcttctgtgctgtatgccagccttttgccttaagttgagaggaggtcaactttagctactgtctttggtttgagagccatggcaaaaaaaaaaaaagaaaaaaagatcaagtcgtctttggtgagccagtaaggtgaaagcttgctgactgtccaaggcacaagagaaaattgaggaattgaaatgcaacctgagtatcaaactaaatattctaatcaaaggtaggtactgttaggtggaattctatcagcaggcaactgcaaatgagaagaagatagaaggacgcccgtcgggactttggagggcattgttattttcccaaagaaagacggccaagggcagaggcatggattctttgcagagcacttccttttggtttttcagtactgtttcatagacagtgggctcacatgttcctgatagtgctgcagttgcttagaaagcatcccagttaattgcagtaattagaacttctggaatatgctagggcagaagtatgtcaagtatgtcacatgaagaaaatgtgaaattcaagagtaatccacacgtgagaaactagacaatgtacattcatgtgttctcttgaaaggaaagggagagctgtaagcttcactctgtcctacaccggagaaaagcaggaataactttaccgtggaaataatgtttagcttttatcagagaaaattgtccttctagagcatagagtcccaaaactcaattctggttttcccctgttttttttttttttttttttcccaacatatgaactgcagcatatcactttttctttttgtgcctcaggttcctcacctgtaaaattgaaaaatatatgtattaataatattattaataataataatggtaatgtagtacttgtttgtaaagcactttgagatccttggttgaaaggcaccataggagtgccaagtattattatgtggccaagggggttatttaaactgtcagttcccaaaggccaggaaaggttggggtcatttttcttaaagacgagctgtaaatatcaactaggcagccaatagtgttgactatgaagatgcaaaactattactaggctgataaaatcatagtttcttaatggctaccaataaggcaaatatcacaataataaacgccaaattccttagggcggactatttgacaaccacatggaaaactttgggggaggcatgaggggggaacatctcaaaatgccaatgtaaaatttaacttacagcaatattcaccagcagaaaatgtctttcatatggaatgatttcatgttgctaagaaaaagaattcaatttgtagtcctgatttgaatactagaatgttggctataatagttctgttcttacaacacatgaaattttttcgttttattttattttgttttcatagtgcatgttcatttctactcacaaacatgttcttggtgtatttcttatgcaaacaatcttcaggcagcaaagatgtctgttacatctaaacttgaataataaagttttaccaccagttacaca

SEQ ID NO: 1453 - DNA, 918 bp, Homo sapiens
ggggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtatacatggcctggtcctaccagagactcacccaatgccagcctccagccagggagagccaagtttgcattttcacacgcatctcacactcctctgcactctcaacttggagagctccaaacagggaaaccccaagccttgctggcttctgccaaccccctgagcagaagcatgggtccccctgatcaccacctcaccaccctcatcctgatctcactgtacactccctttcctggtctgctaagtagcgggtgttttccttgacactaacgctacagctagaccacggtgggcttggcaacaggtgtcttcccagatgctggcgttaccgctagaccaaggagccctctggtggccccgtccgggcataacagaaagctcgcactcttgtcttctggtcactcctcactgtccccttcagcctcctatctctgtatggcctggtgtttcctaggttatgattgtagagcgaggattattataatattggaataaagaataattactacaaactaatgattaatgattcatatataatcatatctaagatctatatctagtataactattcttattttatatattttattatactggaacagctcgtgccctcggtctcttgcctcggcacctgggtggcttgctgcccacatccaccaagtgcactttgggaggctgaggctggaggactgctggaggccaggagttcaataccagcctgggcaacatagggagaccccccccccaccatctcc

SEQ ID NO: 1454 - DNA, 2610 bp, Homo sapiens
ggctgcgatggcggaggccgtggagcgcactgacgagctggtccgggagtacctgctcttccgcgggttcacgcacacactgcggcagctggacgccgagatcaaggcggacaaggagaaggggttccgggtggataagattgtggaccagctgcagcagttaatgcaggtgtatgacttggctgcccttcgggattattggagctacttggagcgtcggctcttcagccgcttggaggatatatacagacccacaatccacaagctgaaaaccagcctgtttcgattttatcttgtctacacaatccagacaaacagaaatgacaaggctcaggagttctttgcaaagcaggccacggaactccagaaccaggctgagtggaaggattggtttgtcctgcccttcctgccatcccggacaccaaccccacctttgctacctacttttctcgacagtgggctgacaccttcattgtgtccctgcacacttcctgagcgtctgtttcagtgcatgccagtccctgtgatcctgaactttgatgcggagtgtcagaggactaaccaggttcaagaagaaaatgaagttctgcgtcagaagctttttgcattgcaagctgaaatccaccgactgaagaaagaggagcaacagccagaagaggaagaggccttggtccaacacaaattgcctccttatgtctccaacatggaccgcctgggggactcggaacttgccatggtgtgcagccaaaggaatgcctccctctcccagtcacttcgtgtgggcttcctgtcctcgctgctgcctcagagtaagaagagcccctcaaggttgtcgcctgctcagggccctcctcaacctcagagctcggccaagaaagagtccttcggtggtcagggcaccaagggaaaggacccgacgtccggagccaaggatgggaagagcctcctcagcgggctggccactggggagtccggttggtcacagcaccggcagcggcgcctgcaggaccatggcaaggagaggaaggagcttttctccacaaccacttcccagtgtgcagagaagaaaccagaagccagtggcccagaggctgagccctgcccagagcttcacacggagccagtggagccactgactcgggcatctcggcaggccctgagggtggaggagtccgcccgagcagccctttattgtgctggacaggaggagtacgggaacaccactcatccatcatgcactgcagagtggattgctctgggaggagagtcgcagcttagacgtagatggggtcatcaaagtgtggtccttcaaccccatcatgcaagaccaaagcatcttcatttcaaatcaccgctgctgtctttgaatggccaccaaacggacagactgctcttgctgggcagtggtgtgggaacagtgcgtctctatgacacggaagccaagaagaatctctgtgaaatcaatatcaacgacaacatgcccaggatcctgtctctgcgtgcagcccaacggggctctttagtctgttcggcagcagctccgagcctcacttcccaggtggacttctcagcaccagacatcggcagcaagggcatgaaccaggttcctggcaggctgctgctgtgggacacgaaaaccatgaagcagcagctccagttctccctggatccagaacccattgctatcaactgtacagccttcaatcacaacgggaacctgctggtcacaggggcagctgatggcgtcatccggctgtttgacatgcagcagcatgagtgcgcgatgagctggagggcccactacgggaggtctactctgtggagttcagctatgatgagaacaccgtgtacagcatcggcgaggacggaagttcatccagtggaacatccacaagagtggcctcaaggtatccgagtacagcctccctcagatgccacgggcccctttgtgctgtctggatacagcggctacaagcaggttcaagtccccaggggccgactcttcgcttttgactcagagggaaattacatgctgacatgttctgccacaggcggcgtcatctacaagctgggtggcgatgagaaggttctggagagctgcttgaagctaggtggccaccgagccctgtggtcaccgtggactggagcactgccatggactgtgggacctgcctcaccgcctccatggatggcaaagatcaagctgaccaccctcctggcccataaagcctgatgacttgccccaagggccacccgaggaagcagtattatctgcggtggggggaggagatataggacaggaaaaccacgtgctccactccagctccctgccagtgcagtgactctgcagggaaagactggcaaggaggctcaggtgcttccatctgtggtgactggaatgggacccacgtggagtaggtgacatatgcttcccagagactggtattgtggctgtgccaggagtacatgtgagactatgggaggaaagctccggaagaaggagaaacattgcagtggctactgtgttggcccagtagaaattgacagtattttgtatatatgtgcccatttatctttttcttttttaaaaaaagagaatactcttgtggc

SEQ ID NO: 1455 - DNA, 862 bp, Homo sapiens
  Modified_base 21: n = a,c,g, or t
agccaccgccgcgtccctctntccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacccgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgca

SEQ ID NO: 1456 - DNA, 615 bp, Homo sapiens
ggggactccgggaggaggaacatggccgtggcggacctcgctctcattcctgatgtggacatcgactccgacggcgtcttcaagtatgtgctgatccgagtccactcggctccccgctccgggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagccccgcctttgcctgcactcctcttgcagggctggccctgcctgctcctgcggcagcctctggtgacgtgctgtccaccaggccttggagacaggctagcctggccacagaattaaacgtgttgccacacctgccggcttcttaaaaaaaaaaaaaaaaaaaaaaaaaaaaa

SEQ ID NO: 1457 - DNA, 1147 bp, Homo sapiens
cacgtggcctccgagcagctcagggcgcccttgaaagttcttggatctgcgggttatggccggtcccttgcagggcggtggggcccgggccctggacctactccggggcctgccgcgtgtgagcctggccaacttaaagccgaatcccggctccaagaaaccggagagaagaccaagaggtcggagaagaggtagaaaatgtggcagaggccataaaggagaaaggcaaagaggaacccggccccgcttgggctttgagggaggccagactccattttacatccgaatcccaaaatacgggtttaacgaaggacatagtttcagacgccagtataagcctttgagtctcaatagactgcagtatcttattgatttgggtcgtgttgatcctagtcaacctattgacttaacccagcttgtcaatgggagaggtgtgaccatccagccacttaaaagggattatggtgtccagctggttgaggagggtgctgacacctttacggcaaaagttaatattgaagtacagttggcttcagaactagctattgctgccattgaaaaaaatggtggtgttgttactacagccttctatgatccaagaagtctggacattgtatgcaaacctgttccattctttcttcgtggacaacccattccaaaaagaatgcttccaccagaagaactggtaccatattacactgatgcaaagaaccgtgggtacctggcggatcctgccaaatttcctgaagcacgacttgaactcgccaggaagtatggttatatcttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcattttcatctaaaattaaatggcaggaaacaaggactgcatagagaaaaaaaaaaaaaaaaaaaaaa

SEQ ID NO: 1458 - DNA, 801 bp, Homo sapiens
atacgggccgcgccgggcaagaagatggcgggatcagtggccgacagcgatgccgtggtgaaactagatgatggccatttaaacaactctttgagctctccagttcaagcggacgtgtacttcccacgactgatagttccattttgtgggcacattaaaggtggcatgagaccaggcaagaaggtgttagtgatgggcatcgtagacctcaacccagagagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcagggtggaaattctttgtgagtacccacgtttccgagtgtttgtggatggacaccaactttttgatttttaccatcgcattcaaacgttatctgcaattgacaccataaagataaatggagacctccagatcaccaagcttggctgatttaaaccacctctatttcaaataggatcacgtgccacaactatctgactgttggtctggaagaagtgtcctagcaagatctggagacttaaaaagaaaacaaaaacaaatggcaagtttcacttaagggtggtttgcccttaagaagaaagctgttgggacaaagacaccgagccattatacccagaataaaataatacatttatgctggattttattcagaccaaactaaaaaaaaaaaaaaaaaaaaaaaaaaaa

SEQ ID NO: 1459 - DNA, 652 bp, Homo sapiens
ggacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactgaagctggagaagccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacaggaaaaaaaaaaaaaaaaaaaaaaaaaaaaaa

SEQ ID NO: 1460 - DNA, 3282 bp, Homo sapiens
gggacagggctgaggatgaggagaaccctggggacccagaagaccgtgccttgcccggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggagtgacgaccgtgttatcaatgaccacactgatgatcgggtcccgcacttctcttcccaacaccaactgcttcatcaaggccatcgatgtgtacctggggatctgctttagctttgtgtttggggccttgctagaatatgcagttgctcactacagttccttacagcagatggcagccaaagatagggggacaacaaaggaagtagaagaagtcagtattactaatatcatcaacagctccatctccagctttaaacggaagatcagctttgccagcattgaaatttccagcgacaacgttgactacagtgacttgacaatgaaaaccagcgacaagttcaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtccattcctctttcatcttaatcaaggacattcccatggagcccaagattacaaatgtactcagggctgtttattcggtggctccctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttgtaacttgttctagaagtcttaatatgggctgttgccatgaaggcttgcagaattgagtccattttctagctgcctttattcacatagtgatggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctctgagtggcttatcccgcatgagcaggagcgtgctggccctgagtactgaactttctgagtaacaatgagacacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagagatgaaatgtggttgtatgagccaatcatatttgtgattttttaaaaaaagtttaaaaggaaatatctgttctgaaaccccacttaagcattgtttttatataaaaacaatgataaagatgtgaactgtgaaataaatataccatattagctacccaccaaaaaaaaaaaaaaaaaa

SEQ ID NO: 1461 - DNA, 1500 bp, Homo sapiens
cggagggtggggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggttcattgcagaagaggccgcggcttctggggccaagtgtgtgctcacccacagcccgacgtggatcatcgaccccatcgacggcacctgcaattttgtgcacagattcccgactgtggcggttagcattggatttgctgttcgacaagagcttgaattcggagtgatttaccactgcacagaggagcggctgtacacgggccggcggggtcggggcgccttctgcaatggccagcggctccgggtctccggggagacagatctctcaaaggccttggttctgacagaaattggccccaaacgtgaccctgcgaccctgaagctgttcctgagtaacatggagcggctgctgcatgccaaggcgcatggggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggc

SEQ ID NO: 1462 - DNA, 3049 bp, Homo sapiens
cccgcgggcaggggcggcgagtgcgcgggccgccgcccttctcggcgggcagcgcgcgaggaccaggccgaggaggaagtggcggcggcggcggcgggctccccgcccgaggaggaagatgcagacctttctgaaagggaagagagttggctactggctgagcgagaagaaaatcaagaagctgaatttccaggctttcgccgagctgtgcaggaagcgagggatggaggttgtgcagctgaaccttagccggccgatcgaggagcagggccccctggacgtcatcatccacaagctgactgacgtcatccttgaagccgaccagaatgatagccagtccctggagctggtgcacaggttccaggagtacatcgatgcccaccctgagaccatcgtcctggacccgctccctgccatcagaaccctgcttgaccgctccaagtcctatgagctcatccggaagattgaggcctacatggaagacgacaggatctgctcgccacccttcatggagctcacgagcctgtgcggggatgacaccatgcggctgctggagaagaacggcttgactttcccattcatttgcaaaaccagagtggctcatggcaccaactctcacgagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcagaccgtgagtccatcttcttcaacagccacaacgtgtcaaagccggagtcgtcatcggtcctgacggagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcaacgccagccccggctgctgcggcagcatgatgggccaggacgcgccctggaaagctgaggccgacgcgggcggcaccgccaagctgccgcaccagagactcggctgcaacgccggcgtgtctcccagcttccagcagcattgtgtggcctccctggccaccaaggcctcctcccagtagccacggagccgggacccagagggcagcgcaggcgcaggagcacacccgctgggccagcagctcccaacggcgatgctactactaagaatccccagtgatctgattcttctgttttttaatttttaacctgattttctgatgtcatgatctaaatgaggggtagaagagagtaccaggtggtccaccgttggggagcggggccgtccgcctgctctctactgtgcagacctcctaactgagtttacacacgcttgtgttgcaacactaggtctggatgggaggtgaggggggtgcgtatactgccatgccagtgtctgtgcacatccctgtctgttgtctccatggccactgtggactgggacccttgaagcctgcccatgtgggtgtgggaggctgatcagtgcgtgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcagggagttccgcgctggggtctgggctgtgctccctcactaaagggaaggaaaggaagctgggcgtcctccgggccccccaacacacgtcccatttagccctgcacagcggtctccttcccctaagccagcactgctgctccctggagccgggaaggaggctgcctggctggaggccgagccgatgggcctgtgctgaggatttgtgctgtgatttgggcaaatcattccaggtctttgggcctccaccccctcgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcgcccagcaggcctggtccacctctcattgcaagcccgcaagcactgagccgagtaaggtgcttagtgtgagccacccgccccccatagcttctgcacacctcagactcaccccatcaccttggcagcaaagcactgctctgccgtctgacccctgatccaggcagcagccccctccgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtcttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgcatttc

SEQ ID NO: 1463 - DNA, 1003 bp, Homo sapiens
tatacacagcccagccagcacccaggtccttccatccttctgctgcacatggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcaagcggaggcgcctggggttgttggccaccgcctggctcaccttctacaacatcgccatgaccgcggggtggttggttctagctattgccatggtacgtttttatatggaaaagggaacacacagagggttatataaaagtattcagaagacacttaaatttttccaaacatttgccttgcttgagatagttcactgtttaattggaattgtacctacttctgtgattgtgactggggtccaagtgagctcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagatataatttttttatcatcttatatcctgttggagttgctggtgaacttcttacaatatacgctgccttgccgtatgtgaagaaaacaggaatgttttcaataagacttcctaacaaatacaatgtctcttttgactactattattttcttcttataaccatggcatcatatatacctttgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaa

SEQ ID NO: 1464 - DNA, 1622 bp, Homo sapiens
tttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaaggtaaatgcaggaatgggtaatagtggtatcactacagaattgactctgaaatacattattactaatgttacaaccttagaaacaggtataagctctgtgaatgctgggcaagatgtgaacataattattacatataaaacatcactatagaataccaacttgggagatgtcgctaaaggacttcagtcaagtaattttggtgttaatatacaaacgtacaccccatctttaactccacagaccaagactggagtaagaccttttaaccctggtagaatgaatgtggcaggagacttatttcagaatggagaatttgcaactcatcatagtcctgattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagaggtctggatttttatacctaagttgttgtttaggctaacagtgataattttaacttttaagtgctattatgtactctttcatctacataatgcacgtgttctggatgtataacatgaagctgaaaggaagaataaggatatgttagaactatcttatgggatattttataaataaaattccatttgcatagc

SEQ ID NO: 1465 - DNA, 11389 bp, Homo sapiens
atggcgccgccgccgccgcccgtgctgcccgtgctgctgctcctggccgccgccgccgccctgccggcgatggggctgcgagcggccgcctgggagccgcgcgtacccggcgggacccgcgccttcgccctccggcccggctgtacctacgcggtgggcgccgcttgcacgccccgggcgccgcgggagctgctggacgtgggccgcgatgggcggctggcaggacgtcggcgcgtctcgggcgcggggcgcccgctgccgctgcaagtccgcttggtggcccgcagtgccccgacggcgctgagccgccgcctgcgggcgcgcacgcaccttcccggctgcggagcccgtgcccggctctgcggaaccggtgcccggctctgcggggcgctctgcttccccgtccccggcggctgcgcggccgcgcagcattcggcgctcgcagctccgaccaccttacccgcctgccgctgcccgccgcgccccaggccccgctgtcccggccgtcccatctgcctgccgccgggcggctcggtccgcctgcgtctgctgtgcgccctgcggcgcgcggctggcgccgtccgggtgggactggcgctggaggccgccaccgcggggacgccctccgcgtcgccatccccatcgccgcccctgccgccgaacttgcccgaagcccgggcggggccggcgcgacgggcccggcggggcacgagcggcagagggagcctgaagtttccgatgcccaactaccaggtggcgttgtttgagaacgaaccggcgggcaccctcatcctccagctgcacgcgcactacaccatcgagggcgaggaggagcgcgtgagctattacatggaggggctgttcgacgagcgctcccggggctacttccgaatcgactctgccacgggcgccgtgagcacggacagcgtactggaccgcgagaccaaggagacgcacgtcctcagggtgaaagccgtggactacagtacgccgccgcgctcggccaccacctacatcactgtcttggtcaaagacaccaacgaccacagcccggtcttcgagcagtcggagtaccgcgagcgcgtgcgggagaacctggaggtgggctacgaggtgctgaccatccgcgccagcgaccgcgactcgcccatcaacgccaacttgcgttaccgcgtgttggggggcgcgtgggacgtcttccagctcaacgagagctctggcgtggtgagcacacgggcggtgctggaccgggaggaggcggccgagtaccagctcctggtggaggccaacgaccaggggcgcaatccgggcccgctcagtgccacggccaccgtgtacatcgaggtggaggacgagaacgacaactacccccagttcagcgagcagaactacgtggtccaggtgcccgaggacgtggggctcaacacggctgtgctgcgagtgcaggccacggaccgggaccagggccagaacgcggccattcactacagcatcctcagcgggaacgtggccggccagttctacctgcactcgctgagcgggatcctggatgtgatcaaccccttggatttcgaggatgtccagaaatactcgctgagcattaaggcccaggatgggggccggcccccgctcatcaattcttcaggggtggtgtctgtgcaggtgctggatgtcaacgacaacgagcctatctttgtgagcagccccttccaggccacggtgctggagaatgtgcccctgggctaccccgtggtgcacattcaggcggtggacgcggactctggagagaacgcccggctgcactatcgcctggtggacacggcctccacctttctggggggcggcagcgctgggcctaagaatcctgcccccacccctgacttccccttccagatccacaacagctccggttggatcacagtgtgtgccgagctggaccgcgaggaggtggagcactacagcttcggggtggaggcggtggaccacggctcgccccccatgagctcctccaccagcgtgtccatcacggtgctggacgtgaatgacaacgacccggtgttcacgcagcccacctacgagcttcgtctgaatgaggatgcggccgtggggagcagcgtgctgaccctgcaggcccgcgaccgtgacgccaacagtgtgattacctaccagctcacaggcggcaacacccggaaccgctttgcactcagcagccagagagggggcggcctcatcaccctggcgctacctctggactacaagcaggagcagcagtacgtgctggcggtgacagcatccgacggcacacggtcgcacactgcgcatgtcctaatcaacgtcactgatgccaacacccacaggcctgtctttcagagctcccattacacagtgagtgtcagtgaggacaggcctgtgggcacctccattgctaccctcagtgccaacgatgaggacacaggagagaatgcccgcatcacctacgtgattcaggaccccgtgccgcagttccgcattgaccccgacagtggcaccatgtacaccatgatggagctggactatgagaaccaggtcgcctacacgctgaccatcatggcccaggacaacggcatcccgcagaaatcagacaccaccaccctagagatcctcatcctcgatgccaatgacaatgcaccccagttcctgtgggatttctaccagggttccatctttgaggatgctccaccctcgaccagcatcctccaggtctctgccacggaccgggactcaggtcccaatgggcgtctgctgtacaccttccagggtggggacgacggcgatggggacttctacatcgagcccacgtccggtgtgattcgcacccagcgccggctggaccgggagaatgtggccgtgtacaacctttgggctctggctgtggatcggggcagtcccactccccttagcgcctcggtagaaatccaggtgaccatcttggacattaatgacaatgcccccatgtttgagaaggacgaactggagctgtttgttgaggagaacaacccagtggggtcggtggtggcaaagattcgtgctaacgaccctgatgaaggccctaatgcccagatcatgtatcagattgtggaaggggacatgcggcatttcttccagctggacctgctcaacggggacctgcgtgccatggtggagctggactttgaggtccggcgggagtatgtgctggtggtgcaggccacgtcggctccgctggtgagccgagccacggtgcacatccttctcgtggaccagaatgacaacccgcctgtgctgcccgacttccagatcctcttcaacaactatgtcaccaacaagtccaacagtttccccaccggcgtgatcggctgcatcccggcccatgaccccgacgtgtcagacagcctcaactacaccttcgtgcagggcaacgagctgcgcctgttgctgctggaccccgccacgggcgaactgcagctcagccgcgacctggacaacaaccggccgctggaggcgctcatggaggtgtctgtgtctgatggcatccacagcgtcacggccttctgcaccctgcgtgtcaccatcatcacggacgacatgctgaccaacagcatcactgtccgcctggagaacatgtcccaggagaagttcctgtccccgctgctggccctcttcgtggagggggtggccgccgtgctgtccaccaccaaggacgacgtcttcgtcttcaacgtccagaacgacaccgacgtcagctccaacatcctgaacgtgaccttctcggcgctgctgcctggcggcgtccgcggccagttcttcccgtcggaggacctgcaggagcagatctacctgaatcggacgctgctgaccaccatctccacgcagcgcgtgctgcccttcgacgacaacatctgcctgcgcgagccctgcgagaactacatgaagtgcgtgtccgttctgcgattcgacagctccgcgcccttcctcagctccaccaccgtgctcttccggcccatccaccccatcaacggcctgcgctgccgctgcccgcccggcttcaccggcgactactgcgagacggagatcgacctctgctactccgacccgtgcggcgccaacggccgctgccgcagccgcgagggcggctacacctgcgagtgcttcgaggacttcactggagagcactgtgaggtggatgcccgctcaggccgctgtgccaacggggtgtgcaagaacgggggcacctgcgtgaacctgctcatcggcggcttccactgcgtgtgtcctcctggcgagtatgagaggccctactgtgaggtgaccaccaggagcttcccgccccagtccttcgtcaccttccggggcctgagacagcgcttccacttcaccatctccctcacgtttgccactcaggaaaggaacggcttgcttctctacaacggccgcttcaatgagaagcacgacttcatcgccctggagatcgtggacgagcaggtgcagctcaccttctctgcaggcgagacaacaacgaccgtggcaccgaaggttcccagtggtgtgagtgacgggcggtggcactctgtgcaggtgcagtactacaacaagcccaatattggccacctgggcctgccccatgggccgtccggggaaaagatggccgtggtgacagtggatgattgtgacacaaccatggctgtgcgctttggaaaggacatcgggaactacagctgcgctgcccagggcactcagaccggctccaagaagtccctggatctgaccggccctctactcctggggggtgtccccaacctgccagaagacttcccagtgcacaaccggcagttcgtgggctgcatgcggaacctgtcagtcgacggcaaaaatgtggacatggccggattcatcgccaacaatggcacccgggaaggctgcgctgctcggaggaacttctgcgatgggaggcggtgtcagaatggaggcacctgtgtcaacaggtggaatatgtatctgtgtgagtgtccactccgattcggcgggaagaactgtgagcaagccatgcctcacccccagctcttcagcggtgagagcgtcgtgtcctggagtgacctgaacatcatcatctctgtgccctggtacctggggctcatgttccggacccggaaggaggacagcgttctgatggaggccaccagtggtgggcccaccagctttcgcctccagatcctgaacaactacctccagtttgaggtgtcccacggcccctccgatgtggagtccgtgatgctgtccgggttgcgggtgaccgacggggagtggcaccacctgctgatcgagctgaagaatgttaaggaggacagtgagatgaagcacctggtcaccatgaccttggactatgggatggaccagaacaaggcagatatcgggggcatgcttcccgggctgacggtaaggagcgtggtggtcggaggcgcctctgaagacaaggtctccgtgcgccgtggattccgaggctgcatgcagggagtgaggatgggggggacgcccaccaacgtcgccaccctgaacatgaacaacgcactcaaggtcagggtgaaggacggctgtgatgtggacgacccctgtacctcgagcccctgtccccccaatagccgctgccacgacgcctgggaggactacagctgcgtctgtgacaaagggtaccttggaataaactgtgtggatgcctgtcacctgaacccctgcgagaacatgggggcctgcgtgcgctcccccggctccccgcagggctacgtgtgcgagtgtgggcccagtcactacgggccgtactgtgagaacaaactcgaccttccgtgccccagaggctggtgggggaaccccgtctgtggaccctgccactgtgccgtcagcaaaggctttgatcccgactgtaataagaccaacggccagtgccaatgcaaggagaattactacaagctcctagcccaggacacctgtctgccctgcgactgcttcccccatggctcccacagccgcacttgcgacatggccaccgggcagtgtgcctgcaagcccggcgtcatcggccgccagtgcaaccgctgcgacaacccgtttgccgaggtcaccacgctcggctgtgaagtgatctacaatggctgtcccaaagcatttgaggccggcatctggtggccacagaccaagttcgggcagccggctgcggtgccatgccctaagggatccgttggaaatgcggtccgacactgcagcggggagaagggctggctgcccccagagctctttaactgtaccaccatctccttcgtggacctcagggccatgaatgagaagctgagccgcaatgagacgcaggtggacggcgccagggccctgcagctggtgagggcgctgcgcagtgctacacagcacacgggcacgctctttggcaatgacgtgcgcacggcctaccagctgctgggccacgtccttcagcacgagagctggcagcagggcttcgacctggcagccacgcaggacgccgactttcacgaggacgtcatccactcgggcagcgccctcctggccccagccaccagggcggcgtgggagcagatccagcggagcgagggcggcacggcacagctgctccggcgcctcgagggctacttcagcaacgtggcacgcaacgtgcggcggacgtacctgcggcccttcgtcatcgtcaccgccaacatgattcttgctgtcgacatctttgacaagttcaactttacgggagccagggtcccgcgattcgacaccatccatgaagagttccccagggagctggagtcctccgtctccttcccagccgacttcttcagaccacctgaagaaaaagaaggccccctgctgaggccggctggccggaggaccaccccgcagaccacgcgcccggggcctggcaccgagagggaggccccgatcagcaggcggaggcgacaccctgatgacgctggccagttcgccgtcgctctggtcatcatttaccgcaccctggggcagctcctgcccgagcgctacgaccccgaccgtcgcagcctccggttgcctcaccggcccatcattaataccccgatggtgagcacgctggtgtacagcgagggggctccgctcccgagacccctggagaggcccgtcctggtggagttcgccctgctggaggtggaggagcgaaccaagcctgtctgcgtgttctggaaccactccctggccgttggtgggacgggagggtggtctgcccggggctgcgagctcctgtccaggaaccggacacatgtcgcctgccagtgcagccacacagccagctttgcggtgctcatggatatctccaggcgtgagaacggggaggtcctgcctctgaagattgtcacctatgccgctgtgtccttgtcactggcagccctgctggtggccttcgtcctcctgagcctggtccgcatgctgcgctccaacctgcacagcattcacaagcacctcgccgtggcgctcttcctctctcagctggtgttcgtgattgggatcaaccagacggaaaacccgtttctgtgcacagtggttgccatcctcctccactacatctacatgagcacctttgcctggaccctcgtggagagcctgcatgtctaccgcatgctgaccgaggtgcgcaacatcgacacggggcccatgcggttctactacgtcgtgggctggggcatcccggccattgtcacaggactggcggtcggcctggacccccagggctacgggaaccccgacttctgctggctgtcgcttcaagacaccctgatttggagctttgcggggcccatcggagctgttataatcatcaacacagtcacttctgtcctatctgcaaaggtttcctgccaaagaaagcaccattattatgggaaaaaagggatcgtctccctgctgaggaccgcattcctcctgctgctgctcatcagcgccacctggctgctggggctgctggctgtgaaccgcgatgcactgagctttcactacctcttcgccatcttcagcggcttacagggccccttcgtcctccttttccactgcgtgctcaaccaggaggtccggaagcacctgaagggcgtgctcggcgggaggaagctgcacctggaggactccgccaccaccagggccaccctgctgacgcgctccctcaactgcaacaccaccttcggtgacgggcctgacatgctgcgcacagacttgggcgagtccaccgcctcgctggacagcatcgtcagggatgaagggatccagaagctcggcgtgtcctctgggctggtgaggggcagccacggagagccagacgcgtccctcatgcccaggagctgcaaggatccccctggccacgattccgactcagatagcgagctgtccctggatgagcagagcagctcttacgcctcctcacactcgtcagacagcgaggacgatggggtgggagctgaggaaaaatgggacccggccaggggcgccgtccacagcacccccaaaggggacgctgtggccaaccacgttccggccggctggcccgaccagagcctggctgagagtgacagtgaggaccccagcggcaagccccgcctgaaggtggagaccaaggtcagcgtggagctgcaccgcgaggagcagggcagtcaccgtggagagtaccccccggaccaggagagcgggggcgcagccaggcttgctagcagccagcccccagagcagaggaaaggcatcttgaaaaataaagtcacctacccgccgccgctgacgctgacggagcagacgctgaagggccggctccgggagaagctggccgactgtgagcagagccccacatcctcgcgcacgtcttccctgggctctggcggccccgactgcgccatcacagtcaagagccctgggagggagccggggcgtgaccacctcaacggggtggccatgaatgtgcgcactgggagcgcccaggccgatggctccgactctgagaaaccgtgaggcaagcccgtcaccccacacaggctgcggcatcaccctcagaccttggagcccaaggggccactgcccttgaagtggagtgggcccagagtgtggcggtccccatggtggcagccccccgactgatcatccagacacaaaggtcttggttctcccaggagctcagggcctgtcagacctggtgacaagtgccaaaggccacaggcatgagggaggcgtggaccactgggccagcaccgctgagtcctaagactgcagtcaaagccagaactgagaggggaccccagactgggcccagaggctggccagagttcaggaacgccgggcacagaccaaagaccgcggtccagccccgcccaggcgggcatctcatggcagtgcggacccgtggctggcagcccgggcagtcctttgcaaaggcaccccttgtcttaaaatcacttcgctatgtgggaaaggtggagatacttttatatatttgtatgggactctgaggaggtgcaacctgtatatatattgcattcgtgctgactttgttatcccgagagatccatgcaatgatctcttgctgtcttctctgtcaagattgcacagttgtacttgaatctggcatgtgttgacgaaactggtgccccagcagatcaaaggtgggaaatacgtcagcagtggggctaaaaccaagcggctagaagccctacagctgccttcggccaggaagtgaggatggtgtgggccctccccgccggccccctgggtccccagtgttcgctgtgtgtgcgtttgtcctctgctgccatctgccccggctgtgtgaattcaagacagggcagtgcagcactaggcaggtgtgaggagccctgctgaggtcactgtggggcacggttgccacacggctgtcatttttcacctggtcattctgtgaccaccaccccctcccctcaccgcctcccaggtggcccgggagctgcaggtggggatggctttgtcctttgctcctgctccccgtgggacctgggaccttaaagcgttgcaggttcctgatttggacagaggtgtggggccttccaggccgttacatacctcctgccaattctctaactctctgagactgcgaggatctccaggcagggttctcccctctggagtctgaccaattacttcattttgcttcaaatggccaattgtgcagagggacaaagccacagccacactcttcaacggttaccaaactgtttttggaaattcacaccaaggtcgggcccactgcaggcagctggcacagcgtggcccgaggggctgtggaacgggtcccggaactgtcagacatgtttgattttagcgtttcctttgttcttcaaatcaggtgcccaaataagtgatcagcacagctgcttccaaataggagaaaccataaaataggatgaaaatcaagtaaaatgcaaagatgtccacactgttttaaacttgaccctgatgaaaatgtgagcactgttagcagatgcctatgggagaggaaaagcgtatctgaaaatggtccaggacaggaggatgaaatgagatcccagagtcctcacacctgaatgaattatacatgtgccttaccaggtgagtggtctttcgaagataaaaaactctagtccctttaaacgtttgcccctggcgtttcctaagtacgaaaaggtttttaagtcttcgaacagtctcctttcatgactttaacaggattctgccccctgaggtgtaatttttttgttctatttttttccacgtactccacagccaacatcacgaggtgtaatttttaatttgatcagaactgttaccaaaaaacaactgtcagttttattgagatgggaaaaatgtaaacctatttttattacttaagactttatgggagagattagacactggaggtttttaacagaacgtgtatttattaatgttcaaaacactggaattacaaatgagaagagtctacaataaattaagatttttgaatttgtacttctgcggtgctggtttttctccacaaacacccccgcccctccccatgcccagggtggccgtggaagggacggtttacggacgtgcagctgagctgtccgtgtcccatgctccctcagccagtggaacgtgccggaactttttgtccattccctagtaggcctgccacagcctagatgggcagtttttgtctttcaccaaatttgaggactttttttttttgccattatttcttcagttttcttttcttgcactgatctttctcctctccttctgtgactccagtgactcagacgttagacctcttgatgttttcccactggtccctgaggctctgttc

SEQ ID NO: 1466 - DNA, 2578 bp, Homo sapiens
cgagcaggcggcaggcacggtccgtgcggagaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgctaaggtgtattagcggacggccctctggccacctacccgagagatcgtagggtcacattcatccaacttcaccacttggctgcttgagattggttctgctcttttcttcattcctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttccgaattatg

SEQ ID NO: 1467 - DNA, 3179 bp, Homo sapiens
ccggttcctgccatgcccggcggccccagtccccgcagccccgcgcctttgctgcgccccctcctcctgctcctctgcgctctggctcccggcgcccccggacccgcaccaggacgtgcaaccgagggccgggcggcactggacatcgtgcacccggttcgagtcgacgcggggggctccttcctgtcctacgagctgtggccccgcgcactgcgcaagcgggatgtatctgtgcgccgagacgcgcccgccttctacgagctacaataccgcgggcgcgagctgcgcttcaacctgaccgccaatcagcacctgctggcgcccggctttgtgagcgagacgcggcggcgcggcggcctgggccgcgcgcacatccgggcccacaccccggcctgccacctgcttggcgaggtgcaggaccctgagctcgagggtggcctggcggccatcagcgcctgcgacggcctgaaaggtgtgttccagctctccaacgaggactacttcattgagcccctggacagtgccccggcccggcctggccacgcccagccccatgtggtgtacaagcgtcaggccccggagaggctggcacagcggggtgattccagtgctccaagcacctgtggagtgcaagtgtacccagagctggagtctcgacgggagcgttgggagcagcggcagcagtggcggcggccacggctgaggcgtctacaccagcggtcggtcagcaaagagaagtgggtggagaccctggtagtagctgatgccaaaatggtggagtaccacggacagccgcaggttgagagctatgtgctgaccatcatgaacatggtggctggcctgtttcatgaccccagcattgggaaccccatccacatcaccattgtgcgcctggtcctgctggaagatgaggaggaggacctaaagatcacgcaccatgcagacaacaccctgaagagcttctgcaagtggcagaaaagcatcaacatgaagggggatgcccatcccctgcaccatgacactgccatcctgctcaccagaaaggacctgtgtgcagccatgaaccggccctgtgagaccctgggactgtcccatgtggcgggcatgtgccagccgcaccgcagctgcagcatcaacgaggacacgggcctgccgctggccttcactgtagcccacgagctcgggcacagttttggcattcagcatgacggaagcggcaatgactgtgagcccgttgggaaacgacctttcatcatgtctccacagctcctgtacgacgccgctcccctcacctggtcccgctgcagccgccagtatatcaccaggttccttgaccgtgggtggggcctgtgcctggacgaccctcctgccaaggacattatcgacttcccctcggtgccacctggcgtcctctatgatgtaagccaccagtgccgcctccagtacggggcctactctgccttctgcgaggacatggataatgtctgccacacactctggtgctctgtggggaccacctgtcactccaagctggatgcagctgtggacggcacccggtgtggggagaataagtggtgtctcagtggggagtgcgtacccgtgggcttccggcccgaggccgtggatggtggctggtctggctggagcgcctggtccatctgctcacggagctgtggcatgggcgtacagagcgccgagcggcagtgcacgcagcctacgcccaaatacaaaggcagatactgtgtgggtgagcgcaagcgcttccgcctctgcaacctgcaggcctgccctgctggccgcccctccttccgccacgtccagtgcagccactttgacgctatgctctacaagggccagctgcacacatgggtgcccgtggtcaatgacgtgaacccctgcgagctgcactgccggcccgcgaatgagtactttgccaagaagctgcgggacgccgtggtcgatggcaccccctgctaccaggtccgagccagccgggacctctgcatcaacggcatctgtaagaacgtgggctgtgacttcgagattgactccggtgctatggaggaccgctgtggtgtgtgccacggcaacggctccacctgccacaccgtgagcgggaccttcgaggaggccgagggtctggggtatgtggatgtggggctgatcccagcgggcgcacgcgagatccgcatccaagaggttgccgaggctgccaacttcctggcactgcggagcgaggacccggagaagtacttcctcaatggtggctggaccatccagtggaacggggactaccaggtggcagggaccaccttcacatacgcacgcaggggcaactgggagaacctcacgtccccgggtcccaccaaggagcctgtctggatccaggtgcctgcctcccgtggcccaggcggggggagcagaggcggagtccccaggcccagcaccctccatggcaggtctcgtcctggaggagtgagccctggttcagtcacagagcctggctctgagccaggccctcctgctgcggcctctacctcagtttccccatctttaaaatggcccaatcttgtagctgcagttcacagaggtggctggggtcaagctcctttaggactgggtggatggagaagacaccttgtgctcatgggcccccgcctgcccacccagctgctgttccaggagagcaaccctggggtgcactacgagtacaccatccacagggaggcaggtggccacgacgaggtcccgccgcccgtgttctcctggcattatgggccctggaccaagtgcacagtcacctgcggcagaggtgagaagtggggcaggcacagccccacctgcaggggcttagtgtctggacagggacactggcttcagctcccagctcactgctgggccaccacgggtttggaagtttgcttctctgagcctcagttctccatctgtgagatgaggctagcgattgccctgtgtcccaggcccgctgggagggtacatggatgaggcaggtgggtgctggctcgcggcgcatgttcagtgtgctccagctcttggcgttctccctccaggggacacagctccccctcgatagaccagtccagtggcccctcaccacactgacttatttccctaaactatttataaaaagtagggcaatttcattaactctgactctt

SEQ ID NO: 1468 - DNA, 757 bp, Homo sapiens
gggccacacccggggctctgaggatttggacaaagactcagtggaaaaactagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccaggccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccctaaaaaaaaaaaaaaaaaaaaaaaaaaccc

SEQ ID NO: 1469 - DNA, 3568 bp, Homo sapiens
atagttttcaggttaagaaagccagaatctttgttcagccacactgactgaacagacttttagtggggttacctggctaacagcagcagcggcaacggcagcagcagcagcagcagcagcagcagcagcagcagggctcctgggataactcaggcatagttcaacactatgggtcctcctctgaagctcttcaaaaaccagaaataccaggaactgaagcaggaatgcatcaaagacagcagacttttctgtgatccaacatttctgcctgagaatgattctcttttctacaaccgactgcttcctggaaaggtggtgtggaaacgtccccaggacatctgtgatgacccccatctgattgtgggcaacattagcaaccaccagctgacccaagggagactggggcacaagccaatggtttctgcattttcctgtttggctgttcaggagtctcattggacaaagacaattcccaaccataaggaacaggaatgggaccctcaaaaaacagaaaaatacgctgggatatttcactttcgtttctggcattttggagaatggactgaagtggtgattgatgacttgttgcccaccattaacggagatctggtcttctctttctccacttccatgaatgagttttggaatgctctgctggaaaaagcttatgcaaagctgctaggctgttatgaggccctggatggtttgaccatcactgatattattgtggacttcacgggcacattggctgaaactgttgacatgcagaaaggaagatacactgagcttgttgaggagaagtacaagctattcggagaactgtacaaaacatttaccaaaggtggtctgatctgctgttccattgagtctcccaatcaggaggagcaagaagttgaaactgattggggtctgctgaagggccatacctataccatgactgatattcgcaaaattcgtcttggagagagacttgtggaagtcttcagtgctgagaaggtgtatatggttcgcctgagaaaccccttgggaagacaggaatggagtggcccctggagtgaaatttctgaagagtggcagcaactgactgcatcagatcgcaagaacctggggcttgttatgtctgatgatggagagttttggatgagcttggaggacttttgccgcaactttcacaaactgaatgtctgccgcaatgtgaacaaccctatttttggccgaaaggagctggaatcggtgttgggatgctggactgtggatgatgatcccctgatgaaccgctcaggaggctgctataacaaccgtgataccttcctgcagaatccccagtacatcttcactgtgcctgaggatgggcacaaggtcattatgtcactgcagcagaaggacctgcgcacttaccgccgaatgggaagacctgacaattacatcattggctttgagctcttcaaggtggagatgaaccgcaaattccgcctccaccacctctacatccaggagcgtgctgggacttccacctatattgacacccgcacagtgtttctgagcaagtacctgaagaagggcaactatgtgcttgtcccaaccatgttccagcatggtcgcaccagcgagtttctcctgagaatcttctctgaagtgcctgtccagctcagggaactgactctggacatgcccaaaatgtcctgctggaacctggctcgtggctacccgaaagtagttactcagatcactgttcacagtgctgaggacctggagaagaagtatgccaatgaaactgtaaacccatatttggtcatcaaatgtggaaaggaggaagtccgttctcctgtccagaagaatacagttcatgccatttttgacacccaggccattttctacagaaggaccactgacattcctattatagtacaggtctggaacagccgaaaattctgtgatcagttcttggggcaggttactctggatgctgaccccagcgactgccgtgatctgaagtctctgtacctgcgtaagaagggtggtccaactgccaaagtcaagcaaggccacatcagcttcaaggttatttccagcgatgatctcactgagctctaaatctgcaatcccagagaatcctgacaaagcgtgccacccttttattttccgtcaggtgccaggtcttagttaagattcacaatctttagaaagaatgagattcacaataattaactcttcctctcttctgataaattccccatacctcccaatccaagtagcatctgtagctacataacctatatacctccagcagctggacatggggaggcgacagtcctatctagacatcatacacatttgccaagaaaggatctctggggcttccgggggtgagattcaagcaggacaataacaagaggctggacaccctacagatgtctttgatgttttcagttgtttgatatatctcccctgtagggcatgttgaggaaggaggagggctgatcaaggccaagctggtctagcctgacatcctagctcctgactgaacactatagacttcccagcagcatttcacccagcagccagagccggctttaagtccccaacccttacagacaccactgccaccaccaccaaccacgaccaccaccaccaccaccactcaccaccatcatcacctccggaaagtgtagtcctgccctaacccaagtcacccccgacagtaaattttaccttcatgttgagaaagcttcctggtgcttaatcaagagctggagttcaatgagtcctagacagtgagaggggcctgagcttcagctcaatggaagcctgctgtgtgccacaagacggaaaagtggaagaagctgcagtgggagacaaagcctcggtcccccacccatccacacacacctacactcacacacgcgcacatgggcgcgcacgaactaccattcaggcagtcagtgggcaagaggaaagataagtaagtaccatacacacctaaaagatgagagaattcatccagacatattacagccagtttggggcccctgactgcaatgtgaaacctctcgctgctgctaggtttacaaacaagcccattgtcctgtgcctcctaatatcatttgtactgaagaccccatctggggacttgagactttggtcccagcccagactcctcagacttttctctcagttgggatgcttcactcgctgggggtgtttgtttgccctctcatttttcagtacttctacagaattttctctagagtcagtcattatgaaatgtacttccctccatcttaacctatcaactttctgcccctccttcaaggcccagtataaatgccacctcctccatgaagccttccctaattccaccccaaacccccaccttcaacaatatttcaacgcttctgcaatgatgaaaaagaaacatagttgtagtacttagcctacctagaccagcaagcattcatttttagctcgctcattttttaccatgttttccagtctgtttaacttctgcagtgccttcactacactgccttacataaaccaaatcacaataaagttcatattcagtaca

SEQ ID NO: 1470 - DNA, 1182 bp, Homo sapiens
gtcctgagcagccaacacaccagcccagacagctgcaagtcaccatggacgctgaaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatgttgaaggataaccatgtggtgccccccggtggcgtggagaaggcggtgcgggcggccagacaggcggctgacttcgctctgaaggtggaagtggaatgcagcagcctgcaggaggtcgtccaggcagctgaggctggcgccgaccttgtcctgctggacaacttcaagccagaggagctgcaccccacggccaccgcgctgaaggcccagttcccgagtgtggctgtggaagccagtgggggcatcaccctggacaacctcccccagttctgcgggccgcacatagacgtcatctccatggggatgctgacccaggcggtcccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtgaacaatggggcacatttggcactagcttgagcccaactctggctctgccacctgctgctcctgtgacctgtcagggctgacttcacctctgctcatctcagtttcctaatctgtaaaatgggtctaataaaggatcaaccaaaaaaaaaaaaaaaaaaaa

SEQ ID NO: 1471 - DNA, 482 bp, Homo sapiens
tcgacccggattccggttccggtgggctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaaataaaaaaaaaaaaaaaaaaaaaaaaaaaaaa

SEQ ID NO: 1472 - DNA, 3065 bp, Homo sapiens
tagttattaaagttcctatgcagctccgcctccgtccggcctcatttcctcaaaaaatccctgctttccccgctcgccacgccctcctgctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagatttgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgaagagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtccctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaataaaaaaaaaaaa

SEQ ID NO: 1473 - DNA, 1721 bp, Homo sapiens
agacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcaggtatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacc

SEQ ID NO: 1474 - DNA, 722 bp, Homo sapiens
cagggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacaggtccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgaggagactttgcggggaggaggcagcagacactggagatgacattcttccacacgagacggggcttcagccggggatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggaaaaaaaaaaaaaaaaaa

SEQ ID NO: 1475 - DNA, 1630 bp, Homo sapiens
atcgcgggccagaggcggagccgccgccctgccgcgactttcagactccgaccatggcctcgcgctggtggcggtggcggcgcggctgctcctggaagccggcggcgcggagccccgggcccggctcccccggccgtgcgggaccgggccggggccgcgcgccgctgccgatgcccgcgcaggctcataggcagaagggacttgacttgtctcagataccctattttaatcttgtgaagcatttaacacctgcctgtccaaatgtatatagtatatcacagtttcatcacacaaccccgtacagcaaaacacacagtggtgagaaatacaccgatcctttcaaactcggttggagagacttgaaaggtctgtatgagggtattagaaaggaacccctcatatcaacaacagaacttaaggaaatctctgagtactactttgatgtaaaaggaaaagcctttagaccgattattgtggtgctaatggcccgagcatgcaatattcatcataacaactcccgacatgtgcaagccagccagcgcgccatagccttaattgcagaaatgatccacactgctagtctggttcacgatgacgttattgacgatgcaagttctcgaagaggaaaacacacagttaataagatctggggtgaaaagaaggctgttcttgctggagatttaattctttctgcagcatctatagctctggcacgaattggaaatacaactgttatatctattttaacccaagttattgaagatttggtgcgtggtgaatttcttcagctcgggtcaaaagaaaatgagaatgaaagatttgcacactaccttgagaagacattcaagaagaccgccagcctgatagccaacagttgtaaagcagtctctgttctaggatgtcccgacccagtggtgcatgagatcgcctatcagtacggaaaaaatgtaggaatagcttttcagctaatagatgatgtattggacttcacctcgtgttctgaccagatgggcaaaccaacatcagctgatctgaagctcgggttagccactggtcctgtcctgtttgcctgtcagcagttcccagaaatgaatgctatgatcatgcgacggttcagtttgcctggagatgtagacagagctcgacagtatgtactacagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaaggtttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattcaaaaaaa

SEQ ID NO: 1476 - DNA, 1137 bp, Homo sapiens
ctccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcggccgaggacgcggcggcccaagctgtggagacgccgggctggaaggccccggaggacgccggcccccagcccggaagttatgagatccgacactatggaccagccaagtgggtcagcacgtccgtggagtctatggactgggattcagccatccagacgggctttacgaaactgaacagctacattcaaggcaaaaacgagaaagagatgaaaataaagatgacagctccagtgacaagctacgtggagcctggttcaggtccttttagtgagtctaccattaccatttccctgtatattccctctgaacagcaatttgatccacccaggcctttagagtcagatgtcttcattgaagatagagccgaaatgactgtgtttgtacggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagtaaagtgcgtgtctagtgtcttctattgagagtactactattaattaagcttatttccaatgtgcctttttaatgcttgaagttttatctacatacacaggtaacagaggacagtagtctgtaaacatataaatcggtcataactatcgtggtctttatttctgtgaggatc

SEQ ID NO: 1477 - DNA, 1635 bp, Homo sapiens
ggcacgagcgcggcgttcacgggaattgttcgctttagtgccggcgccatggggtcggagctgatcgggcgcctagccccgcgcctgggcctcgccgagcccgacatgctgaggaaagcagaggagtacttgcgcctgtcccgggtgaagtgtgtcggcctctccgcacgcaccacggagaccagcagtgcagtcatgtgcctggaccttgcagcttcctggatgaagtgccccttggacagggcttatttaattaaactttctggtttgaacaaggagacatatcagagctgtcttaaatcttttgagtgtttactgggcctgaattcaaatattggaataagagacctagctgtacagtttagctgtatagaagcagtgaacatggcttcaaagatactaaaaagctatgagtccagtcttccccagacacagcaagtggatcttgacttatccaggccacttttcacttctgctgcactgctttcagcatgcaagattctaaagctgaaagtggataaaaacaaaatggtagccacatccggtgtaaaaaaagctatatttgatcgactgtgtaaacaactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctacaaaatggaattggaggccgggcgcagtggctcacgcctgtaatcccagcactttgggaggccaaggtgggtggatcacctgaggtcaggagctcgagaccagcctggccaacatggtgaaaccccatctctactaaaaatacaaaaattagccaggtgtgatggtgcatgcctgtaatcccagctcctcagtaggctgagacaggagcatcacttgaacgtgggaggcagaggttgcagtgagccgagattgcaccaccgcactccagcctgggtgacagagcgagacttatctcataaataaatagatagatactccagcctgggtgacagagcgagacttatagatagatagatagatagatggatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttatttatatatgcaaaaaaaaaaaaaaaaaaaa

SEQ ID NO: 1478 - DNA, 2352 bp, Homo sapiens
cagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaaccc

SEQ ID NO: 1479 - DNA, 1719 bp, Homo sapiens
cgcacggccgcgcagatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgtaaaaaaaaaaaaaaaaaaaaaaaaaaaaa

SEQ ID NO: 1480 - DNA, 11490 bp, Homo sapiens
atgaatacattctggcctggcagagaattgattgttcaatggtatccatttgatgaaaacagaaatcacccatctgtttcatggcttaagatggtttggaaaaatctttatatacatttttcagaggatttgactttatttgatgagatgccacttatccccagaactatactagaggaaggtcagacatgtgtggaactcattagactcaggattccatcgttagtcattttagacgatgaatctgaagcacagcttccagaatttttagcagacattgtacaaaaacttggagggtttgtccttaaaaaattagatgcatctatacaacatccgcttattaaaaaatatattcattcaccattaccaagtgctgttttgcagataatggagaagatgccattgcagaaattgtgtaatcaaataacttcgctacttccaacacacaaagatgccctgaggaagttcttggctagtttaaccgatagcagtgagaaagagaaaagaattattcaagaattggcaatattcaagcgcattaaccattcttctgatcagggaatttcctcttatacaaaattgaaaggttgtaaagtcttacaccatactgccaaactcccagcagatctgcgactttctatttcagtaatagacagtagtgatgaagctactattcgtctggcaaacatgttgaaaatagaacagttaaagaccactagctgcttaaagcttgttttaaaagatattgaaaatgcattttattcacatgaagaggtaacacagcttatgttatgggtccttgagaatctatcttctcttaaaaatgagaatccaaatgtgcttgagtggttaacaccattaaaattcatccagatatcacaggaacagatggtatcagctggtgaactctttgaccctgatatagaagtactaaaggatctcttttgtaatgaagaaggaacctatttcccaccctcagtttttacctcaccagatattcttcactccttaagacagattggtttaaaaaacgaagccagtctcaaagaaaaggatgttgtgcaagtggcaaaaaaaattgaagccttacaggtcggtgcttgtcctgatcaagatgttcttctgaagaaagccaaaaccctcttactggttttaaataagaatcacacactgttgcaatcatctgaaggaaagatgacattgaagaaaataaaatgggttccagcctgcaaggaaaggcctccaaattatccaggctctttggtctggaaaggagatctctgtaatctctgtgcaccaccagatatgtgtgatgtaggccatgcaattctcattggctcctcacttcctcttgttgaaagtatccatgtaaacctggaaaaagcattagggatcttcacaaaacctagccttagtgctgtcttaaaacactttaaaattgttgttgattggtattcttcaaaaacctttagtgatgaagactactatcaattccagcatattttgcttgagatttacggattcatgcatgatcatctaaatgaagggaaagattcttttagagccttaaaatttccatgggtttggactggcaaaaagttttgtccacttgcccaggctgtgattaaaccaatccatgatcttgaccttcagccttatttgcataatgtacctaaaaccatggcaaaattccaccaactatttaaggtctgtggttcaatagaggagttgacatcagatcatatttccatggttattcagaagatatatctcaaaagtgaccaagatctcagtgaacaagaaagcaaacaaaatcttcatcttatgttgaatattatcagatggctgtatagcaatcagattccagcaagccccaacacaccagttcctatacatcatagcaaaaatccttctaaacttatcatgaagccaattcacgaatgctgttattgtgacattaaagttgatgaccttaatgacttacttgaagattctgtggaaccaatcattttggtgcatgaggacatacccatgaaaactgcagaatggctaaaagttccatgccttagtacaagactgataaatcctgaaaacatgggatttgagcagtcaggacaaagagagccacttactgtaagaattaaaaatattctggaagaatacccttcagtgtcagatatttttaaagaactacttcaaaacgctgatgatgcaaatgcaacagaatgcagtttcttgattgatatgagaagaaatatggacataagagagaatctcctagacccagggatggcagcttgtcatggacctgctttgtggtcattcaacaattctcaattctcagattcagattttgtgaacataactaggttaggagaatctttaaaaaggggagaagttgacaaagttggaaaatttggtcttggatttaattctgtgtaccatatcactgacattcccatcattatgagtcgggaattcatgataatgttcgatccaaacataaatcatatcagtaaacacattaaagacaaatccaatcctgggatcaaaattaattggagtaaacaacagaaaagacttagaaaatttcctaatcagttcaaaccatttatagatgtatttggctgtcagttacctttgactgtagaagcaccttacagctataatggaacccttttccgactgtcctttagaactcaacaggaagcaaaagtgagtgaagttagtagtacgtgctacaatacagcagatatttattctcttgtggatgaatttagtctctgtggacacaggcttatcattttcactcagagtgtaaagtcaatgtatttgaagtacttgaaaattgaggaaaccaaccccagtttagcacaagatacagtaataattaaaaaaaaatcctgctcttccaaagcattgaacacacctgtcttaagtgttttaaaagaggctgctaagctcatgaagacttgcagcagcagtaataaaaagcttcccagtgatgaaccaaagtcatcttgcattcttcagatcacagtggaagaatttcaccatgtgttcagaaggattgctgatttacagtcgccactttttagaggtccagatgatgacccagctgctctctttgaaatggctaagtctggccaatcaaaaaagccatcagatgagttgtcacagaaaacagtagagtgtaccacgtggcttctgtgtacttgcatggacacaggagaggctctgaagttttccctgagtgagagtggaagaagactaggactggttccatgtggggcagtaggagttcagctgtcagaaatccaggaccagaagtggacagtgaaaccacacattggagaggtgttttgctatttacctttacgaataaaaacaggcttgccagttcatatcaatgggtgctttgctgttacatcaaataggaaagaaatctggaaaacagatacaaaaggacgatggaataccacgttcatgagacatgttattgtgaaagcttacttacaggtactgagtgtcttacgggacctggccactagtggggagctaatggattatacttactatgcagtatggcccgatcctgatttagttcatgatgatttttctgtaatttgccaaggattttatgaagatatagctcatggaaaagggaaagaactgaccaaagtcttctctgatggatctacttgggtttccatgaagaacgtaagatttctagatgactctatacttaaaagaagagatgttggttcagcagccttcaagatatttttgaaatacctcaagaagactgggtccaaaaacctttgtgctgttgaacttccttcttcggtaaaattaggatttgaagaagctggctgcaaacagatactacttgaaaacacattttcagagaaacagtttttttctgaagtgttttttccaaatattcaagaaattgaagcagaacttagagatcctttaatgatctttgttctaaatgaaaaagttgatgagttctcgggagttcttcgtgttactccatgtattccttgttccttggaggggcatcctttggttttgccatcaagattgatccaccccgaaggacgagttgcaaagttatttgatattaaagatgggagattcccttatggttctactcaggattatctcaatcctattattttgattaaactagttcagttaggtatggcaaaagatgatattttatgggatgatatgctagaacgtgcagtgtcagtagctgaaattaataaaagtgatcatgttgctgcatgcctaagaagtagtatcttattgagtcttatcgatgagaaactaaaaataagggatcctagagcaaaggattttgctgcaaaatatcaaacaatccgcttccttccatttctgacaaaaccagcaggtttttctttggactggaaaggcaacagttttaagcctgaaaccatgtttgcagcaactgacctttatacagctgaacatcaagatatagtttgtcttttgcaaccaattctaaatgaaaattcccattcttttagaggttgtggttcagtgtcattggctgttaaagagtttttgggattactcaagaagccaacagttgatctggttataaaccaattgaaagaagtagcaaaatcagttgatgatggaattacactgtaccaggagaatatcaccaatgcttgctacaaataccttcatgaagccttgatgcaaaatgaaatcactaagatgtcaattattgataagttaaaaccctttagcttcattctagttgagaatgcatatgttgactcagaaaaggtttcttttcatttaaattttgaggcggcaccatacctttatcagttgcctaataagtataaaaataatttccgcgaactttttgaaaccgtgggtgtgaggcagtcatgcactgttgaagattttgctcttgttttggaatctattgatcaagaaagaggaacaaagcaaataacagaagagaattttcagctttgccgacgaataatcagtgaaggaatatggagtctcattagagaaaagaaacaagaattttgtgagaaaaattatggcaagatattattgccagatactaatcttatgcttctccctgctaaatcgttatgctacaatgattgcccttggataaaagtaaaggataccactgtaaaatattgtcatgctgacatacccagggaagtagcagtaaaactaggagcagtcccaaagcgacacaaagccttagaaagatatgcatccaatgtctgttttacaacacttggcacagaatttgggcagaaagaaaaattgaccagcagaattaagagcatccttaatgcatatccttctgaaaaggaaatgttgaaagagcttcttcaaaatgctgatgatgcaaaggcgacagaaatctgttttgtgtttgatcctagacagcatccagttgatagaatatttgatgataagtgggccccattgcaagggccagcactttgtgtgtacaacaaccagccatttacagaagatgatgttagaggaattcagaatcttggaaaaggcacgaaagagggaaatccttataaaactggacagtatggaataggattcaattctgtgtatcatatcacagactgcccatcttttatttctggcaatgacatcctgtgtatttttgatcctcatgccagatatgcaccaggggccacatccattagtcccggacgcatgtttagagatttggatgcagattttaggacacagttctcagatgttctggatctttatctgggaacccattttaaactggataattgcacaatgttcagatttcctcttcgtaatgcagaaatggcaaaagtttcggaaatttcgtctgttccagcatcagacagaatggtccagaatcttttggacaaactgcgctcagatggggcagaacttctaatgtttcttaatcacatggaaaaaatttctatttgtgaaatagataagagtactggagctctaaatgtgctgtattcagtaaagggcaaaatcacagatggagacagattgaaaaggaaacaatttcatgcatctgtaattgatagtgttactaaaaagaggcagctcaaagacataccagttcaacaaataacctatactatggatactgaggactctgaaggaaatcttactacgtggctaatttgtaatagatcaggcttttcaagtatggagaaagtatctaaaagtgtcatatcagctcacaagaaccaagatattactcttttcccacgtggtggagtagctgcctgcattactcacaactataaaaaaccccatagggccttctgttttttgcctctttctttggagactgggctgccatttcatgtgaatggccactttgcactggattcagccagaaggaacctgtggcgtgatgataatggagttggtgttcgaagtgactggaataacagtttaatgacagcattaatagctcctgcatatgttgaattgctaatacagttaaaaaaacggtatttccctggttctgatccaacattatcagtgttacagaacacccctattcatgttgtaaaggacactttaaagaagtttttatcgtttttcccagttaaccgtcttgatctacagccagatttatattgtctagtgaaagcactttacaattgcattcacgaagacatgaaacgtcttttacctgttgtgcgggctccaaatattgatggctctgacttgcactctgcagttataattacttggatcaatatgtctacttctaataaaactagaccattttttgacaatttactacaggatgaattacaacaccttaaaaatgcagattataatatcaccacacgcaaaacagtagcagagaatgtctataggctgaaacatctccttttagaaattggtttcaacttggtttataactgtgatgaaactgctaatctttaccactgtcttatagatgcagatattcctgttagttatgtgacccctgctgatatcagatcttttttaatgacattttcctctcctgacactaattgccatattgggaagctgccttgtcgtctgcagcagactaatctaaaactttttcatagtttaaaacttttagttgattattgttttaaagatgcagaagaaaatgagattgaagttgagggattgccccttctcatcacactggacagtgttttgcaaacttttgatgcaaaacgacccaagtttctaacaacatatcatgaattgattccatcccgcaaagacttgtttatgaatacattatatttgaaatatagtaatattttattgaactgtaaagttgcaaaagtgtttgacatttccagctttgctgatttgttatcctctgtgttgcctcgagaatataagaccaaaagttgcacaaagtggaaagacaattttgcaagtgagtcttggcttaagaatgcatggcattttattagtgaatctgtaagtgtgaaagaagatcaggaagaaacaaaaccaacatttgacattgttgttgatactctaaaagactgggcattgcttccaggaacaaagtttactgtttcagccaaccagcttgtggttcctgaaggagatgttctgcttcctctcagccttatgcacattgcagtttttccaaatgcccagagtgataaagtttttcatgctctaatgaaagccggctgtattcagcttgctttgaacaaaatctgttccaaagacagtgcatttgttcctttgttgtcatgtcacacagcaaatatagagagccccacaagcatcttgaaggctctacattatatggtccaaacttcaacatttagagcagaaaaattagtagaaaatgattttgaggcacttttgatgtatttcaactgcaatttgaatcatttgatgtcccaagatgatataaaaattctaaagtcacttccgtgctataaatccatcagtggccgctatgtaagcattggaaaatttggaacatgctacgtacttacaaaaagtatcccttcagctgaagtggagaaatggacacaatcatcatcatctgcatttcttgaagaaaaaatacacttaaaagaactatatgaggtgattggttgtgtacctgtagatgatcttgaggtatatttgaaacacctcttaccaaaaattgaaaatctctcttatgatgcaaaattagagcacttgatctaccttaagaatagattatcaagtgctgaggaattatcagagattaaggaacaactttttgaaaaactggaaagtttattgataatccatgatgctaacagtagactaaagcaagcaaagcatttctatgatagaactgtgagagtttttgaagttatgcttcctgaaaaattgtttattcctaatgatttctttaagaaattggaacaacttataaaacccaaaaatcatgttacatttatgacatcctgggtggaattcttaagaaatattggactaaaatacatactttctcagcagcagttgttacagtttgctaaggaaatcagtgtgagggctaatacagaaaactggtccaaagaaacattgcaaaatacagttgatatccttctgcatcatatattccaagaacgaatggatttgttatctggaaattttctgaaagaactatctttaataccattcttatgtcctgagcgggcccccgcggaattcattagatttcatcctcaatatcaagaggtaaatggaacacttcctcttataaagttcaatggagcacaggtaaatccaaaattcaagcaatgtgatgtactccagctgttatggacatcctgccctattcttccagagaaagctacacccttaagcattaaagaacaagaaggtagtgaccttggtccacaagaacagcttgaacaagttttaaatatgcttaatgttaacctggatcctcctcttgataaggtaatcaataactgcagaaacatatgcaacataacgacgttggatgaagaaatggtaaaaactagagcaaaagtcttaaggagcatatatgaattcctcagtgcagaaaaaagggaatttcgttttcagttgcgaggggttgcttttgtgatggtagaagatggttggaaacttctgaagcctgaggaggtagtcataaacctagaatatgaatctgattttaaaccttatttgtacaagctacctttagaacttggcacatttcaccagttgttcaaacacttaggtactgaagatattatttcaactaagcaatatgttgaagtgttgagccgcatatttaaaaattctgagggcaaacaattagatcctaatgaaatgcgtacagttaagagagtagtttctggtctgttcaggagtctacagaatgattcagtcaaggtgaggagtgatctcgagaatgtacgagaccttgcgctttacctcccaagccaggatggtagattggtaaagtcaagcatcttagtgtttgacgatgcgccacattataaaagtagaatccaggggaatattggtgtgcaaatgttagttgatctcagccagtgctacttagggaaagaccatggatttcacactaagttgataatgctctttcctcaaaaacttagacctcgattattgagcagtatacttgaagaacaattagatgaagagactcccaaagtttgtcagtttggagcgttgtgttctcttcaaggaagattgcagttactcttgtcttctgaacagttcattacaggactgattagaattatgaagcatgaaaatgataatgcttttctggccaatgaagaaaaagccataagactttgcaaagccctaagagaaggattgaaagtatcctgctttgaaaagcttcaaacaacattaagagttaaaggttttaatcctattccccacagcagaagtgaaacttttgcttttttgaagcgatttggtaatgcagtcatcttgctctacattcaacattcagacagtaaagacattaatttcctgttagcactggcaatgactcttaaatcagcaactgacaatttgatttctgacacttcatatttaattgctatgctaggatgcaatgatatttacaggattggtgagaaacttgacagtttaggagtgaaatatgactcttcggagccatcaaaactggaacttccaatgcctggcacaccaattcctgctgaaattcattacactctgcttatggacccaatgaatgttttttacccgggagaatatgttgggtaccttgttgatgctgaaggtggtgatatctatggatcataccagccaacatacacatatgcaattattgtacaagaagttgaaagagaagatgctgacaattctagttttctaggaaagatatatcagatagatattggttatagtgaatataaaatagttagctctcttgatctgtataagttttcaagacctgaggaaagctctcaaagcagggacagtgctccttctacaccaaccagccccactgagttcctcacccctggcctgagaagcattcctcctcttttctctggtagagagagccacaagacttcttccaaacatcagtcccccaaaaagcttaaggttaattctttaccagaaatcttaaaagaagtgacatctgtggtggagcaagcatggaagcttccagaatcggaacgaaaaaagattattaggcggttgtatttgaaatggcatcctgacaaaaatccagagaaccatgacattgccaatgaagtttttaaacatttgcagaatgaaatcaacagattagaaaaacaggcttttctagatcaaaatgcagacagggcctccagacgaacattttcaacctcagcatcccgatttcagtcagacaaatactcatttcagagattctatacttcatggaatcaagaagcaacgagccataaatctgaaagacagcaacagaacaaagaaaaatgccccccttcagccggacagacttactctcaaaggttctttgttcctcccactttcaagtcggttggcaatccagtggaagcacgcagatggctaagacaagccagagcaaacttctcagctgccaggaatgaccttcataaaaatgccaatgagtgggtgtgctttaaatgttacctttctaccaagttagctttgattgcagctgactatgctgtgaggggaaagtctgataaagatgtaaaaccaactgcacttgctcagaaaatagaggaatatagtcagcaacttgaaggactgacaaatgatgttcacacattggaagcttatggtgtagacagtttaaaaacaagataccctgatttgcttccctttcctcagatcccaaatgacaggttcacttctgaggttgctatgagggtgatggaatgtactgcctgtatcataataaaacttgaaaattttatgcaacaaaaagtgtga

SEQ ID NO: 1481 - DNA, 1274 bp, Homo sapiens
aggtccaggccaatgataaccttataagaggccatgtcgaagcgcgacatcgtcctcaccaatgtcaccgttgtccagttgctgcgacagccgtgcccggtgaccagagcaccgcccccacctgagcctaaggctgaagtagagccccagccacaaccagagcccacaccagtcagggaggaaataaagccaccaccgccaccactgcctcctcaccccgctactcctcctcctaagatggtgtctgtggcccgggagctgactgtgggcatcaatggatttggacgcatcggtcgcctggtcctgcgcgcctgcatggagaagggtgttaaggtggtggctgtgaatgatccattcattgacccggaatacatggtgtacatgtttaagtatgactccacccacggccgatacaagggaagtgtggaattcaggaatggacaactggtcgtggacaaccatgagatctctgtctaccagtgcaaagagcccaaacagatcccctggagggctgtcgggagcccctacgtggtggagtccacaggcgtgtacctctccatacaggcagcttcggaccacatctctgcaggtgctcaacgtgtggtcatctccgcgccctcaccggatgcaccaatgttcgtcatgggtgtcaatgaaaatgactataaccctggctccatgaacattgtgagcaacgcgtcctgcaccaccaactgtttggctcccctcgccaaagtcatccacgagcgatttgggatcgtggaagggttgatgaccacagtccattcctacacggccacccagaagacagtggacgggccatcaaggaaggcctggcgagatgggcggggtgcccaccagaacatcatcccagcctccactggggctgcgaaagctgtgaccaaagtcatcccagagctcaaagggaagctgacagggatggcgttccgggtaccaaccccggatgtgtctgtcgtggacctgacctgccgcctcgcccagcctgccccctactcagccatcaaggaggctgtaaaagcagcagccaaggggcccatggctggcatccttgcctacaccgaggatgaggtcgtctctacggacttcctcggtgatacccactcgtccatcttcgatgctaaggccggcattgcgctcaatgacaatttcgtgaagctcatttcatggtacgacaacgaatatggctacagtcaccgggtggtcgacctcctccgctacatgttcagccgagacaagtgaaacgggaaggtcct

SEQ ID NO: 1482 - DNA, 2010 bp, Homo sapiens
gccacagcccagctgttccctccgcggattctccggggctggttcatcacctccgaatattcctgtgacaggagacgcttgcaaaacccgcctccagcctccagcagcaaataaatagaaggcttgcagcccagaaggagccagaagaagtttctaggcacgaggccctgggtttattaagctcctggctccgctctagacctcagcggttctggctgccagcctgggcagcctgggaagcctgggaggacggtggcttgccggtctgtcgtgaggcagtgcggacggggaccctctgggattctgctggatctgccccgggggttacctttgggggctgggaccccagtcgaggggacacaaccgtccctggcagtggttggttctgcttctccctgcagaaaagcagcattttcggaagctgaagaataagctagcccagccacaccaccttgttgtgtgaccttgggcaggtggttctgtctctctgagcctctgtttctctctgagctgagcagccaccatggctgacggtcagatgcccttctcctgccactacccaagccgcctgcgccgagaccccttccgggactctcccctctcctctcgcctgctggatgatggctttggcatggaccccttcccagacgacttgacagcctcttggcccgactgggctctgcctcgtctctcctccgcctggccaggcaccctaaggtcgggcatggtgccccggggccccactgccaccgccaggtttggggtgcctgccgagggcaggacccccccacccttccctggggagccctggaaagtgtgtgtgaatgtgcacagcttcaagccagaggagttgatggtgaagaccaaagatggatacgtggaggtgtctggcaaacatgaagagaaacagcaagaaggtggcattgtttctaagaacttcacaaagaaaatccagcttcctgcagaggtggatcctgtgacagtatttgcctcactttccccagagggtctgctgatcatcgaagctccccaggtccctccttactcaacatttggagagagcagtttcaacaacgagcttccccaggacagccaggaagtcacctgtacctgagatgccagtactggcccatccttgttttgtccccaaccctagggcttctctgattccaggatacattactttagctgaactcagatttagtgcaagtaaaatgttagagggtgcgggggtgaggactgaccacagattccctggatagtgtagtggtagatttctccacaggatagcgcaattggcaaatcatgcttggttgtgttaggccaaaatactagttttgctttctttaccttttctatcttgatgaaaatgttgcacattctatagttgcaaaacacataaaaggggacttaacatttcacgttgtatcttacttgcagtgaatgcaagggttacttttctctggggacctcccccatcacccaggttcctactctgggctcccgattcccatggctcccaaaccatgccgcatggtttggttaatgaaacccagtagctaaccccactgtgcttccacatgcctggcctaaaatgggtgatatacaggtcttatatccccatatggaatttatccatcaaccacataaaaacaaacagtgccttctgccctctgcccagatgtgtccagcacgttctcaaagtttccacattagcactccctaaggacgctgggagcctgtcagtttatgatctgacctaggtcccccctttcttctgtcccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataataaaggagctgacgttcttaaaaaa

SEQ ID NO: 1483 - DNA, 1749 bp, Homo sapiens
gtggcctcgaggtggtggcagggccgccccctgcagtccggagacgaacgcacggaccgggcctccggaggcaggttcggctggaaggaaccgctctcgcttcgtcctacacttgcgcaaatgtctccgagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagacgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaacaacttttgccccctgactgatagcatttcagaatgtgtcttttgaagggctataccagttattaaatagtgttttattttaaaaacaaaataattccaagaagtttttatagttattcagggacactatattacaaatattactttgttattaacacaaaaagtgataagagttaacatttggctatactgatgtttgtgttactcaaaaaaactactggatgcaaactgttatgtaaatctgagatttcactgacaactttaagatatcaacctaaacatttttattaaatgttcaaatgtaagcaagaaaaaaaaaa

SEQ ID NO: 1484 - DNA, 3637 bp, Homo sapiens
gggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaataagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatactgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttctt

SEQ ID NO: 1485 - DNA, 2950 bp, Homo sapiens
gcaggctgctgtctcacagagcgagaaggtgtcaggagcagcccagttgtgtctctctctctacctctgtgaagggcgcgaatgggcagagcagaacttctagaagggaagatgagcacccaggatccctcagatctgtggagcagatccgatggagaggctgagctgctccaggacttggggtggtatcacggcaacctcacacgccatgctgctgaagctcttctcctctcaaatggatgtgacggcagctaccttctgagggacagcaatgagaccaccgggctgtactctctctctgtgagggccaaagattctgttaaacactttcatgttgaatatactggatattcatttaaatttggctttaatgaattctcatctttgaaggattttgtcaagcattttgcaaatcagcctttgattggaagcgagacaggcactctgatggttctaaaacatccctacccaagaaaagtggaagaaccctccatttatgaatctgtccgggttcacacagcaatgcagacaggaagaacagaagatgaccttgtgcccacagcaccttctctgggcaccaaagaaggttacctcaccaaacagggaggcctggtcaagacctggaaaacaagatggtttactctgcacaggaatgaactgaaatacttcaaagaccagatgtcaccagaaccaattcggatcctagacctaacagaatgttcagctgtacaattcgattattcacaagaaagggtaaactgtttttgtttggtatttccattcaggacattttatctctgtgcaaagaccggagtagaagctgatgagtggatcaagatattacgctggaaattggtcaaggacaaaagctgtattttgtctgctctctgtatatctcccgaggagaagactgatcacaaataagaaaacagctcaaccaaggggaaggcacgatccgatctcggtcgttcatctttaaatagatctttcttgccaaggaatgctctggcccaggagcaaggtggaatgtttccctgacgctgtgatctgcagcaggcttcaaatgaaaaccgactaaggattttctttcaaaaacaaatcagaagcagatgctgattgggacccatataccacgttgctgactcacgttgctgcccttccatgatgttgccatctccttgagaacactgaagcaatcaccattctgatagaaagtgcttaaaccaccactcttaggtctgctcactcttagaacacacaatggaagaggaagggtttttgttttcactcattgtggtccccaagcctattgacactagttgcctagagtcccactgtgagtcatggtcagcctgtctgacatccaggttgtgctattaaccaagaaggaaacagatacttggaggcttagatgacttctgcaggatttatattcagatagaaaacatcaaatattttcaggggagaggtttttttttttaatttttccccctttatacaaaaaaaaagaacatttccaaaactaaaatagaaaatgcttgtggcatttattttctctttttaaaaggttcagaaatttggcaggtcctttgcttctaatgacaaaactgtgagagctagatgtcctatgggcaattaggtagtataataaaggtaaatgaaggtacaatttttaaaccattattttcaccctgttggggtaaatgttttaaagagtgagaaaacataaattgagaaagggtgataaagtaatagataacttttagtttaataataattattgttattatactactaataatagagcacttgtaagcactaagttatctttatccaacatttctccaaatggactgaaagaaacttttcaaggacagtgtattataacaatccctttcccagaattagttgtatagggttggcccaagagatgtaagaaaaatctcgcattgctccctaagcaccctgggccttattaaagagcaacttctatttccagtcgggggagtaacactaaagctacaagaaatatgtaataatgataggtaataatgtgttccaaagctttttcaaactagaataaggaggcaaatagaagaatgagatactgatgtccacagttcattggcagaatctaaccccttctgttatcttttttaatactatttttgtttagatagaagtttcaaagaagataaaaatgcttgaagagcctgagagtaaaaagattatgctgcaaagctatgatataaactgctcttgcagtccaaagggatacctgattaaagaagtttcttatttaaacatctcagacgcaaaaattacattaaatttttgtatatttcaacaacattttaaatgtattttgttatgtttgtattatataggataaagcaaatgtcaagttaaaatgtattgtgttgtttgtaaagtaagaagttactggccaggagcggcggctcatgcctgtaatcccaggactttggtaggccaagacaagcagatcacttgaggtcaggagttcaacatcagcctggccaacatgatgaaaccttgtctttactaaaaatacaaaaattagctgggcatggtggcaggcgcctgtaatcccagctactcaggaggctgaggcaggagaattgcttgaacccgggaggtggaggttgcagtgaaccaagatcgcggcgctgcactctagcctgggtgacagagtcagactccgtcccaaaaaaacaaacaaacaaaacaaaacaaaaaaaacagaagttacaaatgaatactcacggatatgtatagttttatgtttgttttcttagaaacaaatgtgtttctttgggtgggtaatattgtgttttactatgtttaccttttataaaacataacctgtttatttatattctttggctttgtttattaaaaagcatgattttgctgtgcatgtaccattttg

SEQ ID NO: 1486 - DNA, 3178 bp, Homo sapiens
ggcaccgattcggggcctgcccggacttcgccgcacgctgcagaacctcgcccagcgcccaccatgccccggcagctcagcgcggcggccgcgctcttcgcgtccctggccgtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcaactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacagctggaaccagttcatcaaccgtcagccacacaactgggaacaccactcaacccagtaaccagaccacccttccagcaactttatcgatagcactgcacaaaagcacaaccggtcagaagcctgatcaacccacccatgccccaggaacaacggcagctgcccacaataccacccgcacagctgcacctgcctccacggttcctgggcccacccttgcacctcagccatcgtcagtcaagactggaatttatcaggttctaaacggaagcagactctgtataaaagcagagatggggatacagctgattgttcaagacaaggagtcggttttttcacctcggagatacttcaacatcgaccccaacgcaacgcaagcctctgggaactgtggcacccgaaaatccaaccttctgttgaattttcagggcggatttgtgaatctcacatttaccaaggatgaagaatcatattatatcagtgaagtgggagcctatttgaccgtctcagatccagagacagtttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatgtggatgagtgctcgtctgactacacaattgtgcttcctgtgattggggccatcgtggttggtctctgccttatgggtatgggtgtctataaaatccgcctaaggtgtcaatcatctggataccagagaatctaattgttgcccggggggaatgaaaataatggaatttagagaactctttcatcccttccaggatggatgttgggaaattccctcagagtgtgggtccttcaaacaatgtaaaccaccatcttctattcaaatgaagtgagtcatgtgtgatttaagttcaggcagcacatcaatttctaaatactttttgtttattttatgaaagatatagtgagctgtttattttctagtttcctttagaatattttagccactcaaagtcaacatttgagatatgttgaattaacataatatatgtaaagtagaataagccttcaaattataaaccaagggtcaattgtaactaatactactgtgtgtgcattgaagattttattttacccttgatcttaacaaagcctttgctttgttatcaaatggactttcagtgcttttactatctgtgttttatggtttcatgtaacatacatattcctggtgtagcacttaactccttttccactttaaatttgtttttgttttttgagacggagtttcactcttgtcacccaggctggagtacagtggcacgatctcggcttatggcaacctccgcctcccgggttcaagtgattctcctgcttcagcttcccgagtagctgggattacaggcacacactaccacgcctggctaatttttgtatttttattatagacgggtttcaccatgttggccagactggtcttgaactcttgacctcaggtgatccacccacctcagcctcccaaagtgctgggattacaggcatgagccattgcgcccggccttaaatgttttttttaatcatcaaaaagaacaacatatctcaggttgtctaagtgtttttatgtaaaaccaacaaaaagaacaaatcagcttatattttttatcttgatgactcctgctccagaattgctagactaagaattaggtggctacagatggtagaactaaacaataagcaagagacaataataatggcccttaattattaacaaagtgccagagtctaggctaagcactttatctatatctcatttcattctcacaacttataagtgaatgagtaaactgagacttaagggaactgaatcacttaaatgtcacctggctaactgatggcagagccagagcttgaattcatgttggtctgacatcaaggtctttggtcttctccctacaccaagttacctacaagaacaatgacaccacactctgcctgaaggctcacacctcataccagcatacgctcaccttacagggaaatgggtttatccaggatcatgagacattagggtagatgaaaggagagctttgcagataacaaaatagcctatccttaataaatcctccactctctggaaggagactgaggggctttgtaaaacattagtcagttgctcatttttatgggattgcttagctgggctgtaaagatgaaggcatcaaataaactcaaagtatttttaaatttttttgataatagagaaacttcgctaaccaactgttctttcttgagtgtatagccccatcttgtggtaacttgctgcttctgcacttcatatccatatttcctattgttcactttattctgtagagcagcctgccaagaattttatttctgctgttttttttgctgctaaagaaaggaactaagtcaggatgttaacagaaaagtccacataaccctagaattcttagtcaaggaataattcaagtcagcctagagaccatgttgactttcctcatgtgtttccttatgactcagtaagttggcaaggtcctgactttagtcttaataaaacattgaattgtagtaaaggtttttgcaataaaaacttactttgg

SEQ ID NO: 1487 - DNA, 1831 bp, Homo sapiens
gccgcgccgcccgcacgtggcagccccaggccccggccccccacccacgtctgcgttgctgccccgcctgggccaggcccaaaggcaaggacaaagcagctgtcagggaacctccgccggagtcgaatttacgtgcagctgccggcaaccacaggttccaagatggtttgcgggggcttcgcgtgttccaagaactgcctgtgcgccctcaacctgctttacaccttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctatttttttatatgattattctgttacttgtatttattgttcagttttctgtatcttgcgcttgtttagccctgaaccaggagcaacagggtcagcttctggaggttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagatgtgttgtggtaaaaagtgttagtataaaaatggataatttacttgtgtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaagttctcagtattgtaacagcaacttgtcaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatggaagaattgatcgatgaaaaaaaaaa

SEQ ID NO: 1488 - DNA, 428 bp, Homo sapiens
aaaaataagtaggaagtgctcaattttaatttggttcagttttccggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaggatccagctgcctatgaaaatgacaaatgagcaacgcatccggatgacggttccctgtctctgaaagacctttctctggaagaggagtctgcattgtagtgtctcaaagacacaataaacttcctatggtctg

SEQ ID NO: 1489 - DNA, 2859 bp, Homo sapiens
atgaacctgtgtggcctcatgcccatcttccccgctcccctcgaccaggtggctgacatggaggagctgaccatctgggaacagcacacggccacactgtccaaggacccccgccggggctttggcattgcgatctctggaggccgagaccggcccggtggatccatggttgtatctgacgtggtacctggagggccggcggagggcaggctacagacaggcgaccacatcgtcatggtgaacggggtttccatggagaatgccacctccgcgtttgccattcagatactcaagacctgcaccaagatggccaacatcacagtgaaacgtccccggaggatccacctgcccgccaccaaagccagcccctccagcccagggcgccaggactcggatgaagacgatgggccccagcgggtggaggaggtggaccagggccggggctatgacggcgactcatccagtggctccggccgctcctgggacgagcgctcccgccggccgaggcctggtcgccggggccgggccggcagccatgggcgtaggagcccaggtggtggctctgaggccaacgggctggccctggtgtccggctttaagcggctgccacggcaggacgtgcagatgaagcctgtgaagtcagtgctggtgaagaggagagacagcgaagagtttggcgtcaagctgggcagtcagatcttcatcaagcacattacagattcgggcctggctgcccggcaccgtgggctgcaggaaggagatctcattctacagatcaacggggtgtctagccagaacctgtcactgaacgacacccggcgactgattgagaagtcagaagggaagctaagcctgctggtgctgagagatcgtgggcagttcctggtgaacattccgcctgctgtcagtgacagcgacagctcgccattggaggaaggcgtgaccatggctgatgagatgtcctctccccctgcagacatctcggacctcgcctcggagctatcgcaggcaccaccatcccacatcccaccaccaccccggcatgctcagcggagccccgaggccagccagaccgactctcccgtggagagtccccggcttcggcgggaaagttcagtagattccagaaccatctcggaaccagatgagcaacggtcagagttgcccagggaaagcagctatgacatctacagagtgcccagcagtcagagcatggaggatcgtgggtacagccccgacacgcgtgtggtccgcttcctcaagggcaagagcatcgggctgcggctggcagggggcaatgacgtgggcatcttcgtgtccggggtgcaggcgggcagcccggccgacgggcagggcatccaggagggagatcagattctgcaggtgaatgacgtgccattccagaacctgacacgggaggaggcagtgcagttcctgctggggctgccaccaggcgaggagatggagctggtgacgcagaggaagcaggacattttctggaaaatggtgcagtcccgcgtgggtgactccttctacatccgcactcactttgagctggagcccagtccaccgtctggcctgggcttcacccgtggcgacgtcttccacgtgctggacacgctgcaccccggccccgggcagagccacgcacgaggaggccactggctggcggtgcgcatgggtcgtgacctgcgggagcaagagcggggcatcattcccaaccagagcagggcggagcagctggccagcctggaagctgcccagagggccgtgggagtcgggcccggctcctccgcgggctccaatgctcgggccgagttctggcggctgcggggtcttcgtcgaggagccaagaagaccactcagcggagccgtgaggacctctcagctctgacccgacagggccgctacccgccctacgaacgagtggtgttgcgagaagccagtttcaagcgcccggtagtgatcctgggacccgtggccgacattgctatgcagaagttgactgctgagatgcctgaccagtttgaaatcgcagagactgtgtccaggaccgacagcccctccaagatcatcaaactagacaccgtgcgggtgattgcagaaaaagacaagcatgcgctcctggatgtgaccccctccgccatcgagcgcctcaactatgtgcagtactaccccattgtggtcttcttcatccccgagagccggccggccctcaaggcactgcgccagtggctggcgcctgcctcccgccgcagcacccgtcgcctctacgcacaagcccagaagctgcgaaaacacagcagccacctcttcacagccaccatccctctgaatggcacgagtgacacctggtaccaggagctcaaggccatcattcgagagcagcagacgcggcccatctggacggcggaagatcagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtggacagccgccacccccagggacagtggcgacaggacagcatgcgaacctatgaacgggaagccctgaagaaaaagtttatgcgagtacatgatgcggagtcctccgatgaagacggctatgactggggtccggccactgacctgtga

SEQ ID NO: 1490 - DNA, 2219 bp, Homo sapiens
cccatttcaggtgggacttgtggcataggagaggtcttgggactggtgcccagcctggtgcagtcccctcccaaagcctccctctcccacacagccgtgagagcctgtgggcctagaggactcagctggcaggttgcagggaggcgcagccttttgcaatcccccagggccacaggttaccctccttctctctctagacccccagctctaccaggagatccaggagcggggcctgaacaccagccaggagtctgatgacgacatcctcgatgagtcctccagccccgagggaacccagaaggtggacgccaccattgtggtcaagagctaccggcccgcccaggtcacctggagccagctcccggaggtggtggaattgggcatcctggaccagctctccactgaggagcggaaaaggcagagggccatgttcgagatcctcacgtcggagttctcctaccagcacagcctgagcatcctggtggaggagttcctgcagtccaaggagctgcgggcgaccgtgacccagatggagcaccaccacctcttctccaacatcctggatgtcctgggtgccagtcagaggttcttcgaggacctggagcagcggcacaaggcccaggtgctggtcgaggacatcagtgacatcctggaggagcacgctgagaagtacttccacccctacatcgcctactgctccaacgaggtctaccaacagcgcacgctgcagaagctgataagcagcaacgccgccttccgagaggccctgagagagattgagaggcggccggcgtgcgggggcctgcccatgctctccttcctgatcctccccatgcagcgggtgacccggctgcccctcctgatggatacgctctgcctcaagacccagggccactccgaaaggtacaaggctgccagccgtgcactgaaggccatcagcaagctggtgaggcagtgcaacgagggggcccacaggatggagcgcatggagcagatgtacacgctgcacacacagctggacttcagcaaggtcaagtccctcccactgatctccgcctcccggtggctgctgaagcgcggagagctgttcttagtggaagaaaccggactttttcgaaaaattgccagccggccaacgtgctaccttttcctgttcaacgatgtcctggttgtgaccaagaagaagagcgaggagagctacatggtccaggactacgcccagatgaaccacatccaggtagagaagatagagccgtctgagctccctctgcccgggggcggcaaccgtagctcctccgtgccccaccccttccaggtgaccctgcttcgcaacagcgagggccgccaggagcagctcctgctctcctcggactccgcgagtgaccgggcacggtggatcgtggcgctcacacacagtgagagacagtggcagggcctctccagcaaaggagacctgccccaggtggagatcaccaaggccttcttcgcgaagcaagcagacgaggtcacactgcagcaggcggacgtggtcctggttctgcagcaggaggatgggtggctctatggcgagaggctccgggacggagagacgggatggttccccgaggactttgcccgcttcatcaccagccgtgtggccgtggagggcaatgtccgcaggatggagcgtctgcgggtggagacggacgtgtaggcctggcgaggccagccggcggcagcacagcctgtccccaatcagcaagtggtcgtgcctggctctagagagcgtggggagctggtctcaaggacccagcatggttccctggggcttcccaagagcctgtggctgtggtgccgggctccagacacttcacggaaggaagatcacatgtccccagagaggcacccccaggcaagctcgagggggccacaccgtgtcccagggagcccagcctattcccgttggctggctgggcccctctcagctgctgggccccacctccccactgcacccaggggacaactccacctggactgatgggcacaggaggcaccaatagcgattattgggggcaatgcgaggtctcctcctatgcccttcctacccctgagtgggacaagaagggccttgagtgcccaggagtgccccacgttctgagaaggggccggccggagggaggggacccggcagggagatttcggttttgaggtttctaaatacattaaagttatttcttaag

SEQ ID NO: 1491 - DNA, 1514 bp, Homo sapiens
gagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatgg

SEQ ID NO: 1492 - DNA, 1232 bp, Homo sapiens
gccaccaccagtattggggatgctgagctgcggggtacgggcctgaggagggatgggagtaagaagtgctgtggaaaccgtcaggccatgaaccaggctgaccctcggctcagagcagtgtgcttgtggactctcacatctgcagccatgagcagaggcgacaactgcacggatctactcgcactgggaatcccctccataacccaggcctggggactgtgggtcctcttaggggctgtgacgctgctatttctcatctcgctggctgcacacttgtcccagtggaccaggggccggagcaggagccatccggggcagggacgctctggagagtctgtggaagaggtcccgctgtatgggaacctgcattatctacagacaggacggctgtctcaagacccagagccagaccagcaggatccaactcttggaggccctgccagggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggctgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtcccaagttttcaaataaaactttccaaaaaagtg

SEQ ID NO: 1493 - DNA, 1968 bp, Homo sapiens
atggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtag

SEQ ID NO: 1494 - DNA, 903 bp, Homo sapiens
cggcggcggcgacaggaccgaggggccttagttggtgggcaagtcggggatcccagaaagagaagcgtgacccggaagcggaaacgggtgtccgtcccagctccggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgttatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacactaaaaaaaaaaaaaaaaaaaaaaa

SEQ ID NO: 1495 - DNA, 1626 bp, Homo sapiens
agcagcggcgggggcccgagggattctgaaggaagatttccattaggtaatttgtttaatcagtgcaagcgaaattaagggaaaatggatgtagaaaatgagcagatactgaatgtaaaccctgcagatcctgataacttaagtgactctctcttttccggtgatgaagaaaatgctgggactgaggaagtaaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggatgggcgatccagatctgggaaaggaaggggactaccaaagaaaggtggtgcaggaggcaaaggtgtctggggtacacctggacaggggtatgatgtggaggaggtggatgtgaaagatcctaactatgatgatgaccaggagaactgtgtttatgaaactgtagttttgcctttggatgaaagggcatttgagaagactttaacaccaatcatacaggaatattttgagcatggagatactaatgaagttgcggaaatgttaagagatttaaatcttggtgaaatgaaaagtggagtaccagtgttggcagtatccttagcattggaggggaaggctagtcatagagagatgacatctaagtttctttctgacctttgtgggacagtaatgagcacaactgatgtggaaaaatcatttgataaattgttgaaagatctacctgaattagcactggatactcctagagcaccacagttggtgggccagtttattgctagagctgttggagatggaattttatgtaatacctatattgatagttacaaaggaactgtagattgtgtgcaggctagagctgctctggataaggctaccgtgcttctgagtatgtctaaaggtggaaagcgtaaagatagtgtgtggggctctggaggtgggcagcaatctgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttggaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttgggta

SEQ ID NO: 1496 - DNA, 1722 bp, Homo sapiens
gcggccggtcgaccggagtggctgccctgcgcggggacactcagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggacgggaactactttgaacacaagcataatattcggcccaaacctttcgtgatcccgggccgaagcagtggatgcagcactccctccgggattgactgtggcagtggacgcagcaccccttcttctgtcagtactgttagtaccatttgcccaggtgacttgaaagttgcggctaagctggcccctaacattcctttggaaatggaacttcctggtgtgaagattgtacatgctcagtttaatacacctatgcagttgtactcagatgacaatattatggaaacactccagggtcaggtttcaacagccctaggggaaacacctttgatgaacgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagttggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaggatttaaaaaaaaaaaaaaaaaaaa

SEQ ID NO: 1497 - DNA, 2187 bp, Homo sapiens
cgcccgggcaggtgagaaattggagaagataaaactggacactggggagaccacaacttcatgctgcgtgggatctcccagctacctgcagtggccaccatgtcttgggtcctgctgcctgtactttggctcattgttcaaactcaagcaatagccataaagcaaacacctgaattaacgctccatgaaatagtttgtcctaaaaaacttcacattttacacaaaagagagatcaagaacaaccagacagaaaagcatggcaaagaggaaaggtatgaacctgaagttcaatatcagatgatcttaaatggagaagaaatcattctctccctacaaaaaaccaagcacctcctggggccagactacactgaaacattgtactcacccagaggagaggaaattaccacgaaacctgagaacatggaacactgttactataaaggaaacatcctaaatgaaaagaattctgttgccagcatcagtacttgtgacgggttgagaggatacttcacacatcatcaccaaagataccagataaaacctctgaaaagcacagacgagaaagaacatgccgtctttacatctaaccaggaggaacaagacccagctaaccacacatgtggtgtgaagagcactgacgggaaacaaggcccaattcgaatctctagatcactcaaaagcccagagaaagaagactttcttcgggcacagaaatacattgatctctatttggtgctggataatgccttttataagaactataatgagaatctaactctgataagaagctttgtgtttgatgtgatgaacctactcaatgtgatatataacaccatagatgttcaagtggccttggtaggtatggaaatctggtctgatggggataagataaaggtggtgcccagcgcaagcaccacgtttgacaacttcctgagatggcacagttctaacctggggaaaaagatccacgaccatgctcagcttctcagcgggattagcttcaacaatcgacgtgtgggactggcagcttcaaattccttgtgttccccatcttcggttgctgttattgaggctaaaaaaaagaataatgtggctcttgtaggagtgatgtcacatgagctgggccatgtccttggtatgcctgatgttccattcaacaccaagtgtccctctggcagttgtgtgatgaatcagtatctgagttcaaaattcccaaaggatttcagtacatcttgccgtgcacattttgaaagataccttttatctcagaaaccaaagtgcctgctgcaagcacctattcctacaaatataatgacaacaccagtgtgtgggaaccaccttctagaagtgggagaagactgtgattgtggctctcctaaggagtgtaccaatctctgctgtgaagccctaacgtgtaaactgaagcctggaactgattgcggaggagatgctccaaaccataccacagagtgaatccaaagtctgcttcactgagatgctaccttgccaggacaagaaccaagaactctaactgtcccaggaatcttgtgaattttcacccataatggtctttcacttgtcattctactttctatattgttatcagtccaggaaacaggtaaacagatgtaattagagacattggctctttgtttaggcctaatctttctttttacttttttttttcttttttctttttttttaaagatcatgaatttgtgacttagttctgccctttggagaacaaaagaaagcagtcttccatcaaatcaccttaaaatgcacggctaaactattcagagttaacactccagaattgttaaattacaagtactatgctttaatgcttctttcatcttactagtatggcctataaaaaaaataataccacttgatgggtgaaggctttggcaatagaaagaagaatagaattcaggttttatgttattcctctgtgttcacttcgccttgctcttgaaagtgcagtatttttctacatcatgtcgagaatgattcaatgtaaatatttttcattttatcatgtatatcctatacacacatctccttcatcatcatatatgaagtttattttgagaagtctacattgcttacattttaattgagccagcaaagaaggcttaatgatttattgaaccataatgtcaataaaaacacaacttttgaggc

SEQ ID NO: 1498 - DNA, 890 bp, Homo sapiens
ggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcggctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagca

SEQ ID NO: 1499 - DNA, 5145 bp, Homo sapiens
cgggcccctcgccactaccgccgccgccgccgccgtgagtcccgcggagccgcgcgcgcccccggctgggccgagccgctggccgacgagcggagcctcaggagccggcggggacgccatgcgagccagcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaacctgttaagtgtgtgtgtgttttctgtacccaaccagactttaaataaaacaaacatgaaacctaaaaaaaaaaaaaaaaaaaaaa

SEQ ID NO: 1500 - DNA, 2250 bp, Homo sapiens
ccgccgctccggacccgcagccgccgccgccgcctcctccccccggatcgggtgtactgtcctaacccgaaagtccagttctgcggcccggcagcggcgagcgggcgcgatgacacaggagtacgacaacaaacggccagtgttggctcttcagaatgaagcactttatccacagcggcggtcctacactagtgaggatgaggcctggaaatccttcctggaaaaccctctcactgcagcgaccaaagcgatgatgagcatcaatggagatgaagacagcgccgctgcgctgggcctgctctatgactactacaaggttccaagagagagaaggtcatcaacagcaaagccagaggtggagcaccctgagccagatcacagcaaaagaaacagcataccaattgtgacagagcagcccctcatctctgctggagaaaacagagtgcaagtactgaaaaatgtgccatttaacattgtccttccccatggcaaccagctgggcattgataagagaggccatctgacagctccagatacgacagtcactgtctccatagcaacgatgcctacccactccatcaagacagaaacccagcctcatggcttcgctgtgggaatccccccagcagtgtatcatcctgagcccactgagcgggtggtggttttcgatcggaatctcaatactgaccagttcagctctggtgctcaagccccaaatgctcaaaggcgaactccagactcgaccttctcagagaccttcaaggaaggcgttcaggaggttttcttcccctcggatctcagtctgcggatgcctggcatgaattcagaggactatgtttttgacagtgtttctgggaacaactttgaatataccctagaagcttcaaaatcacttcgacagaagccaggagacagtaccatgacgtacctgaacaaaggccagttctatcccatcaccttgaaggaggtgagcagcagtgaaggaatccatcatcccatcagcaaagttcgaagtgtgatcatggtggtttttgctgaagacaaaagcagagaagatcagttaaggcattggaagtactggcactcccggcagcacaccgctaaacaaagatgcattgacatagctgactataaagaaagcttcaacactatcagtaacatcgaggagattgcgtataacgccatttccttcacatgggacatcaacgatgaagcaaaggttttcatctctgtgaactgcttaagcacagatttctcttcccagaagggagtgaaggggttgcctcttaacattcaagttgatacctatagttacaacaaccgcagcaacaagcctgtgcaccgggcctactgccagatcaaggtcttctgtgacaagggagctgagcggaaaatcagggatgaagaacgaaagcaaagcaaaagaaaagtttctgatgttaaagtgccactgcttccctctcacaagcgaatggatatcacagttttcaaacccttcattgatctcgatactcagcctgtcctcttcattcctgacgtgcactttgccaacttgcagcggggcactcatgtccttcccattgcctctgaagaattggagggtgaaggctctgtcttgaaaagggggccgtacggcacagaagatgactttgctgtccctccttctaccaagctggcccggatagaagaaccaaagagagtgctgctctacgttcgaaaggagtcagaagaagtctttgatgccctgatgctcaaaaccccatctttgaagggcttgatggaagctatctcagacaaatacgatgttccccatgacaagattgggaaaatattcaagaagtgtaaaaaggggatcctggtgaacatggacgacaacattgtgaagcattactccaatgaggacaccttccagctgcagattgaagaagccggggggtcttacaagctcaccctgacggagatctaaaggcctgcgggccacagctccccaggagttcagtgcaggtgtttctagatcttacggtttggcaactgcaggtaaccccagtcagccatgtcgccagcacaggtctatgtcgagggaatgggttccttgcaggttggaggcggggctgcatctggcttggtggtagcatttaatctattgcattggtgtttttcagatgaaagagaaatccatataccattatgtttgaatttcctgatatatacaggatttaaagtgaaaactttattccaagagttaacaga

SEQ ID NO: 1501 - DNA, 4909 bp, Homo sapiens
ttcggagcgcgaagccgccgctgggacctcggcgcgccccgcgtctgcgcttgctgccgcgccccggtcggcgcgctgggagttccagccatgctcttctggcacacgcagcccgagcactacaaccagcacaactccggcagctacctgcgtgatgtgctcgctctgcccatcttcaagcaggaggaaccccagctgtcccccgagaacgaggcccgcctgccacccctgcaatatgtgttgtgtgctgccacgtccccagccgtgaagctgcatgaagagacgctgacctacctcaaccaaggtcagtcttatgaaatccgactactggagaatcggaagctgggagactttcaagatctgaacacaaaatatgtcaagagcatcatccgtgtggtcttccatgaccgccggctgcagtatacggagcaccagcagctggagggctggcggtggagtcggccaggggaccggatcctggacatcgatattccactgtctgttggtatcttggaccccagggccagcccgacccagctgaatgcagtcgagtttttgtgggaccctgcgaagagagcttctgcattcattcaggtacactgcatcagcacagaattcacccccaggaagcacgggggcgagaagggagtgccctttcgagtccagattgacacgtttaagcagaacgagaatggggagtacacggagcacctgcactcagccagctgccagatcaaggtgttcaagccgaagggagccgatcggaaacagaagactgaccgggagaagatggagaaaagaactgcccaagagaaggagaaataccagccgtcctatgaaaccaccatcctcacagagtgctctccatggcccgacgtggcctaccaggtgaacagcgccccgtccccaagctacaatggttctccaaacagctttggcctcggcgaaggcaacgcctctccgacccacccggtggaggccctgcccgtgggcagtgaccacctgctcccatcagcttcgatccaggatgcccagcagtggcttcaccgcaacaggttctcgcagttctgccggctctttgccagcttctcaggtgctgacttgctgaagatgtcccgagatgatttggtccagatctgtggtcccgcagatgggatccggctcttcaacgccatcaaaggccggaatgtgaggccaaagatgaccatttatgtctgtcaggagctggagcagaatcgagtgcccctgcagcagaagcgggacggcagtggagacagcaacctgtctgtgtaccacgccatcttcctggaagagctgaccaccttggagctgattgagaagattgccaacctgtacagcatctccccccagcacatccaccgagtctaccggcagggccccacgggcatccatgtggtggtgagcaacgagatggtgcagaacttccaagatgaatcctgttttgtcctcagcacaattaaagctgagagcaatgatggctaccacatcatcctgaaatgtggactctgagcagcagtggacctcatacctgtctccagctcccagccctgtggatccccgtggatgtagacattgccccactgtaagctgtggcctcaccaggcaagctgaggccaggagggaccctgcccagtctgtgaaagctacagagcaccaaccagcagaagcctgtggacaccaagtacggtgtacagaaagccagtggctcctttctcccttcctcttggcctccagattttgaatggttccttgttcttttctattggtccaaccctgacgttctaaaagggcaaacagtggagacgtctgctctgaaatccctcatcccttagttggaagctgattgggtatcttggtgctgcctgtattggtcccttctgaccactctcctgcctccagagaaagctctgcttcaccctgaaagctggtacctttacctcctcctctgggagttggctgcatggccagcactgccgacttgatgggagcagtttgccctcattctcctgtttcaggtttgcttcccttctcagtgaccctggtgagcatccgcctttcctgttcttggatgaattgatgggagtggggctattctgtgccttctacctctttcttctctacgttgtttctaaggatctgctgctgcggaacccaaagatgtgctcctgtctctgcactggcgcattggcatggtagatgccacaatgtatgtgcacggcctttctcagagacattagttctgaggccctttgtggggaggttagggggatggtaatagaaaaagactattttatttcctggcaatcacgggtaaggaggattaggaatgagtattccattcctaggtgtcatcagatgaccttgaccaccacaataccaggccctcttggatggacttatagaaagttagagaagaccttgttgaaccgctgctaaacttgccacaggagcgatgtgttttctctgagtgcccctcacttacatgtttatctttgtttgtagaggctatgtttaggatattttgcctgcatcagaatgggtgcatcatctttcttaatggcctatcgggaaatttgagtgtcagtaactgtggtagactcagaaattcgtctttgtcttgcctctggttcctgggatccagtgatctctactggcccagggcttcagctcttggttaatttaggttcatggggaaccctctgaccacctgaatgggatgtcatagcttctaaatggagcttctgtggaatgaagtgctagactgaaggactaccagaataaaacagggtctacaatggggagaacttgttttatagatgaggaaaccaaggctcagaggggcaaagtcacctgcatggtagcacatagtgatagggtagcgatataaatttatcatataaaccaggacatctcggaataaaaggggctctgttagtcattatgttgggtaatagccatggcattcctacagaacagagtgaggacaggctcctgattcctcttccttctttagagagaagcggggagtgggttaactaacagctttattgagatgtcattcacatgccattcagtttacccattgctagtgtccaattgtattcacagaaccaccatcaattcacagaattacagtcaacgttggtacattttcatcacccccagtaaaaccccgtacccttggtctgtcactcctgctttcctaactcctgcagtccaaggcagccatgaatctactttctatgtaagattaacctactctggacatttcatatatctggaatcatgtgatatctcttttgtgactggcttcttccactgaatgttttctagggccgtccaagttgaggatgtatcagtacttcattcttttgtattgctgaataatacttcattgtatagatagaccacatttgtttattgattcatcagttgatggacatttgtgtgtttttactttttggctactctgaatgatgctgctatgaacatatttctacaagattttgtgtggacatatgttttcatttcttttagcaatatacataggagtggaattgctaggtcttacagtaactccgtgttttaactttttgagaaactgccagactgttttctatagcagctgtaccattttacattcccaccagcaatgtatccaggtttcaatttgtctacatcctcatcaacacttgctattatctgtctttttgcttttagcatcctaatgagtatgaaatgctatcttgtggttttgatttgcattcccctgatggcaactgatgctgagtgtcttttcctgtgcttacgggccatgcgtatttctttggagaaaggtctatccaggtcctttgcctatttttaattgagttgtcttttttttttaagttttctgttttcctaaccactagactaccagggatgagccttctttttattattgagttgggtgagctatttgtatattctagacgccagtcttttatcaggtatatgactggtaaaaatgttctccccttctgtggattgttttcagtttcttgttggtgtcctttgagacacaaaactttttaactttgatgatttccaagatacgtattttttttctattgtcacttgtgcttttggtgccatatctagaaaaccattgcctaatccaaggtcaagaagattaatgcctgtgttttcttctaagaacttgtatagttttagttctcacaatggtctttgatccatttcgagtatatttttatatatgatgtgatgtaggggtccagcttcattcttttgcttgtggatctccacttgtcccactgctgattattgagaaaaatatcctttctccacggaattgtcttggcatccttgctaaaggcctctgcttcttactggatcttctttcctgggacatggtgtcgttgggaagcttacctttttttttttttacttagtctgtgtttggttccaccagttttatgctgcctttctactctgttcttgctgtctccctctttacctgagtcaacggtactgagtcctatctctctctgatgttccccagtcttccttggtgcatgttctagctccacacactagtccttggaggaaggttgagaccaatgatttcctgttatgagtcatgaggaaactgaatcacctagaagtggaataatgtgctcagggtcaccatagcccattagtggaaggaccaggactagacctttagtcttctgaggtccagccccttaggctgtctgtcatcactgtacccaagtgatgtcactaccaaggccaaatgatggtgggctaaattttaattctcaaaagtgtaggaggctaatattgtcttctaagttccaaaagaagatgtaataaaagtctgttacct

SEQ ID NO: 1502 - DNA, 2030 bp, Homo sapiens
ggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaagttactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcggcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaa

SEQ ID NO: 1503 - DNA, 2112 bp, Homo sapiens
cggctttcaaagccaatttgaataaacaactcttccctctcaaatgggcaagagtaactcttcagcaccatggagaggtccgggcagcgtgttacaacgtgggactgtgaccagggcaagcactctgacagtgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaacccg

SEQ ID NO: 1504 - DNA, 2443 bp, Homo sapiens
agctggctcagggcgtccgctaggctcggacgacctgctgagcctcccaaaccgcttccataaggctttgctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgarcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgtcctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaggactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggraaaaaaattggraaaaggaaaaactcagttttaaatacgggagactataatggataacactgrattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatc

SEQ ID NO: 1505 - DNA, 970 bp, Homo sapiens
agcagcgctccctccgcttccggccgagcccgcgccccccagaccccgagagctcgcagctccggcccggcggcgatggcgcggagcgtgcgcgtgctggtggacatggacggcgtcctggccgacttcgaggccggcctcctgcggggcttccgccgccgcttccctgaggagccgcacgtgccgctggagcaacgccgcggcttcctggcccgcgagcagtaccgcgccctgcggcccgacctggcggataaagtggccagtgtgtacgaagccccgggctttttcctggacctggagcccatcccgggagccttggacgctgtgcgggagatgaacgacctaccggacacgcaggtcttcatctgcaccagccccctgctgaagtaccaccactgtgtgggtgagaagtaccgctgggtggagcagcacctggggccccagttcgtagaacgaattatcctgacaagggacaagacggtggtcttgggggacctgctcattgatgacaaggacacagttcgaggccaggaggagaccccaagctgggagcacatcttgttcacctgctgccacaatcggcacctggtcctgcccccgacaaggagacggctgctctcctggagtgacaactggagggagatcttagatagcaagcgcggagctgcgcagcgggaatgagcggggatgccgcgggcagcagctggagctaaaggaagggcaggcccacaggggccaccgcagagccgagtcggggcggcatcgtgctggtgcctctggccccgtggagtggagcaggcagacaccgttaagcgctgtgctaccgggccccaggcccagccacccggtacctcccgagaggctgtccctggaccctggctggcatggaaatacagtgggaaaaccagtcgggacctttaataaaagaccttggctttctaaaaaaaaaaaaaaaaaaaaaaaaaaaaaa

SEQ ID NO: 1506 - DNA, 2366 bp, Homo sapiens
ggcacgagcgagggagccggaaagatggtggttaccagatctgcacgggctaaggccagcatccaagccgcgtcggctgaaagttccgggcaaaagagttttgctgctaatgggattcaagcgcatccagaaagtagtactggatctgatgcccgaactactgatgaatcacagaccactgggaagcaaagtttaatccctagaactcctaaagctagaaagagtaagagcagaactacaggctcactaccaaaggggactgaaccatctacggatggagagacctctgaggcagagtcaaattattctgtgtctgagcaccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaaatatattaacagtgcacgaacaggccaatgttgaatctcttaaagaaacaaaacagaattgtaaggatttggatgaagatgccaatggaataacagatgaggggaaagaaattaatgagaaaagttctcagctgaagaatctttctgaacttcaggacactagccttcaacagttagtttctcagagacattcaaccccccaaaataaaaatgctgtatcagtgcactctaatctgaactctgaggctgtaatgaaatcattaactcaaacatttgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagattttgaatgtgataccaaactatacacgtctgcgcccaacacatctcagggtaaagataattctgtcttactagttctcagcagtgatgaaagccaacagtctgaaaacagtgagaatgaagaggatactttatgttttgttgaaaatagtggccaaagggagtcattaagtggagacacaggaagtctgtcatgtgacaatgcattgtttgtaattgacacaactcctggaatgagtgctgataaaaatttttacttggaagaggaagacaaggcaagtgaggttgccattgaggaagaaaaagaagaggaagaggatgaaaaaagtgaagaagattcatcagaccatgacgaaaatgaagatgagtttagtgatgaagaagacttcctaaatagcacaaaggctaaacttctgaagttgacaagcagcagcatagaccctggtctgagtatcaagcagttgggtggtttgtatattaattttaatgcagataaactacagtctaacaagagaaccctaacacagatcaaggagaaaaagaaaaatgagcttctgcagaaagccgtcattacacctgattttgaaaaaaaccactgtgttccaccatatagtgaatcaaagtatcaacttcagaaaaaacgcagaaaagaacgacaaaaaacagcaggggatggctggtttggtatgaaagctccagaaatgacaaatgaactgaaaaatgatctcaaagcactgaagatgagagccagcatggacccgaaaagattttacaagaaaaatgatagagatggcttccccaagtacttccagattggaaccattgttgacaatccagctgatttctaccattcacgaattcccaagaagcaaaggaaaagaactattgtggaagactgctggctgattctgaattcagagatacaaccgaaggaagtactcagagatcatggctgaaaaagcagcaaatgcagcaggaaaaaagttccgaaagaagaagaaatttcgcaattaagatttaccaagcaaactgcaacattttacattgctcctttatttacttattaaagacgtttggaaaactaaaa

SEQ ID NO: 1507 - DNA, 470 bp, Homo sapiens
gggaccgctataaggccagtcggactgcgacatagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacacctctgggggtcctctctgagtcaaatccagtggtgggtaattgtacaataaattttttttggtcaaattt

SEQ ID NO: 1508 - DNA, 4243 bp, Homo sapiens
gtcactcacctctggattagcctgaagcggagactaccggctgcggagcggcggggcgagacacttgctcgccttttgaccccatcatgtcgcggggctccatcgagattcccctccgggacactgacgaggtcattgaacttgacttcgatcagttaccggagggagatgaagttatcagtattctgaaacaggaacacacacaactgcacatatggattgctttggcgctggaatactacaagcaaggaaaaacagaagagtttgtaaaattgttggaagcagcacgtatagatggcaatttggactatagagaccatgaaaaagaccagatgacttgcttggatacattggcagcgtattatgtacaacaggctcggaaagaaaagaataaggacaataaaaaggatcttattacacaggccaccttgttgtatacaatggccgataaaattattatgtatgatcagaaccatttgttgggaagagcctgcttctgcctacttgagggtgacaaaatggatcaagctgatgcacagtttcattttgtactcaatcagtctccaaataatattccagcccttcttggtaaagcttgcatttccttcaacaagaaggattacagaggagctcttgcttactataagaaagcattgcgtactaacccaggatgtccagcggaagttcgtttaggaatgggtcattgctttgtgaaacttaacaaactggaaaaagctcgtctggcattcagcagagccctggaactcaattccaaatgcgtgggagcattggttggactggctgttctagaactcaacaataaagaggctgattccattaaaaatggtgtccagcttctttccagagcctatactattgatcctagcaaccctatggtattgaaccatttggcaaatcactttttcttcaaaaaggattatagtaaagtccagcatctggccctccatgcattccataatacagaagtggaagctatgcaagcagagagctgctatcagctagctagatcattccatgttcaggaagattatgaccaagcttttcagtactattatcaagccacacagtttgcctcatcctcttttgtgctcccattttttggtttgggacaaatgtatatttatcgaggtgacaaagaaaatgcatctcagtgctttgagaaggttttgaaagcttatcctaataattacgaaactatgaaaattctcggctctctctatgctgcctcagaagatcaagaaaaacgagatattgccaagggccatttgaagaaggtcacagaacagtatcccgatgatgttgaagcttggattgaattggcacaaatcttagaacagactgatatacagggtgccctttcagcctatggaacagcaacacgaatccttcaggagaaagtgcaggccgatgttcctccagagattctcaataatgtgggtgccctccattttagacttggaaacctaggggaggctaagaaatattttttggcgtcattggaccgtgcaaaagcagaagcggaacacgatgagcattactataacgccatttccgttaccacgtcatataatctcgccaggctatatgaggcgatgtgtgaattccatgaagcagaaaaactgtataaaaacatcttacgcgaacatcctaattatgttgactgctatttgcgcctaggagccatggctagagataagggaaacttttatgaggcttcagattggtttaaggaagctcttcagattaatcaggatcatccagatgcttggtctttgattggcaatcttcatttggcaaaacaagaatggggtcctgggcagaagaagtttgagaggatattaaaacagccatccacacagagtgatacctattctatgctagcccttggcaacgtgtggctccaaactttacatcagcccacccgagatcgagaaaaggaaaagcgtcatcaagatcgtgctctggccatctacaaacaagtactcagaaatgatgcaaagaatctgtatgctgccaatggcataggagctgttttggcccacaaaggatattttcgtgaagctcgtgatgtatttgcccaagtaagagaagcaacagcagatattagtgatgtgtggctgaacttagcacacatctatgtggagcaaaagcagtacatcagcgccgttcagatgtatgaaaactgcctccgaaagttctataagcaccaaaacactgaagttgtactctatttggcccgggccctcttcaagtgtggcaagttacaggaatgcaaacagactttgctgaaggctagacatgtggcacccagtgatacagttcttatgtttaatgtggccttggtcctgcaaagattagctacctctgtcctgaaagatgaaaaaagtaatctgaaggaagtacttaatgctgtgaaagaactggagcttgcacatagatacttcagttatttgagtaaagtgggagataaaatgagatttgatttggcccttgctgctacagaagccaggcagtgttctgacttactgagccaggcccagtaccatgtggcccgggcacgcaaacaagatgaagaagagcgggagctgcgggccaagcaagagcaagaaaaggagctgttaaggcagaaacttcttaaagaacaggaagagaaacgtctcagagaaaaggaagagcaaaagaaacttttggaacagcgggcccagtatgtggagaagaccaaaaatattcttatgtttactggtgagactgaagcaacaaaagagaagaaaagaggtggtggtggtggacggcgttctaagaagggaggagagtttgatgaatttgtcaatgatgacactgatgatgacctacctatatccaaaaagaagaagagaagaaagggtagtggcagtgaacaagaaggtgaagatgaggagggtggtgagagaaagaagaaaaagaggagaagacatccaaagggagaagaaggatctgatgatgatgaaacagaaaatggccccaaaccaaaaaaacgacgtccaccaaaagcagagaagaaaaaggctcccaagccagaacgtctgcctccatcaatgaagggaaaaataaaatccaaagccataatttcatcaagtgatgactcttcggatgaggataaacttaaaattgctgatgaaggacatcccaggaacagcaacagcaacagtgactcagacgaggacgaacaacgaaagaaatgtgcctcatcagagagtgattccgatgagaaccagaacaagtctggcagcgaggccggcagtccccggaggccacgaagacagcggtcagatcaggactcagacagtgaccagccatccagaaagagaaggccctccggttctgagcagtctgacaatgaatctgtgcagtcagggagaagccactcaggagtttctgagaacgactctcgcccagcttctccaagtgccgaatcagatcacgaatcggagagaggatctgataatgagggttctggccaaggctctggaaatgaatcggaaccagagggatccaacaatgaggcctcagatagaggctcagaacatgggtcagatgatagtgactaggttttatttcatcaataagcttcatctctggaggaaacttttttaatatatgaaagctgtgataaaaatgtttcagatgtttagtcaattgtgaaatttttcttaaggcaattttcttttctatcagtttgtatattactaagccccaagagacatttcctgtgctagagtccaatatttgagtctctcgtgcaaatgagactattctttgtggtacaattccacctatcatatgtgaaaactgcagtaaaaataaacccagatgctaaatcattcctacaaaggtttgactgaaactgtggcagatgtctcatcttctttatatgttaagcagcatactcttctgatttttattgcaatcttttaccaagtggtgcacaaacttggtattgatgtctttattccattttgagtttagattgagaatatttttattttctgaaggcagagatatctactgtataattgcaccaaagtacatttgaaaggaaggttttcaatagtgtaatactgcagcgatgtagataaaatcacaaatgtataatgtgttaggttgaataaggtgtggaaaatgcttttctgttagtagaatgcaaaaacctacctaagccacataataataaaattcttttacc

SEQ ID NO: 1509 - DNA, 4831 bp, Homo sapiens
gccgagccggggcgaagctggatcccctagatagactgtcttcaagctcactgatattttcctctgcttgatccattgtgctgttgagagcctctagtaaatttttcagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctcagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccatcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggagcagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttctaccttaagtgagccatgtgtggtttgtctgggggccctggtgtggttgctgagttgtagctcaagaggagaaaacatacagaacatatttggaccggaaatcctttgttctgaatttgagggggtcttctgaggtccttatttccttaggtctttcctcacccctctcccaccgctgtcctgaggagaaacccttgaacttcctcagtagacaggcggagaggccacaacatgccgaacccatttcctgtcatcctagtcttgggtcttcaccgcctccttccaaatacccaccctgccagcagccctaggtcttcctgttctgaccccccatcactgctcgttcagccttctagacgtctctctcgtggacatctgttctttagctgttggctttctctgaggtgtgagagggtctatgaactttgtgaatttcccatggccccagtgaaggagcccagataatcccagtagctgttacctgtctccatgtatcaaaggacacagtccagggggagggtggaaggagatgtggtttctctatagtgcaacaaacatggtttctcaatgttctgctgtgcagcaagcagggtctggcggcttggtaggtgggtttcaggagcagtcactattgtaggatgggcttccaatcaaacctcagactaaactcttgtactgaactgattctacctccctcctctagactcagtaaacagtgactattcaat

SEQ ID NO: 1510 - DNA, 2535 bp, Homo sapiens
cgctgtagtgcggcgccccaggttctttagtggaagaacgcgaagcgaggatgagtgatccgtggaggcagtaacaggcgcggcgagggagaagtgattcccgaagaatcaaggctgggccggacccggtggcctggcaacagggtaataagagaaatgaagccaacaggtacagacccaaggatcttatctatagctgctgaagttgcaaaaagccctgagcagaatgtccctgttatactgttgaagttaaaagaaataataaacatcacacctttaggaagctcagagttgaagaaaatcaaacaagatatatattgttatgatctcattcaatattgcctcttggtcctcagtcaagattattctcgaatccagggtggttggactacaatttcccagcttacacagatattaagccattgctgtgtgggcttggagccaggagaagatgcagaggaattttacaatgaattacttccatcagctgcagaaaattttctagttttggggagacaattacaaacatgttttatcaatgcagctaaggctgaagaaaaagatgaattactacactttttccaaattgtgactgattctctcttctggcttttgggaggccatgttgaacttattcagaatgtactacaaagtgatcatttcttacatttactgcaagctgacaatgtccaaataggatctgcagtcatgatgatgctacagaatatattacagatcaacagtggtgatttactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgattatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacat

SEQ ID NO: 1511 - DNA, 6033 bp, Homo sapiens
cggggcgtgcgcgtcctcctccccaggcccgccgcctccctgccaagaatctgagagaggccgagtggagttcggtccttctctgaacagttttagctgagagtaccagcatccaactgggagcgttgtcattgcatttccacattcccaggaaagcccaggtgctggctgccagctgctgcgccccccatgtagaaggtgcacctcctgggagcaggcacgtcttttggctcttctgaccatggagagataggacggtccctgcagcccgcgcgacagaaagctgtgccgccaccaccggccgcgtccgtccttcggatggatcgcaacagagaggccgagatggagctgaggcgaggccccagccccaccagggccggccggggccacgaggtggatggggacaaggctacctgccacacctgctgcatctgcggcaagagcttccccttccagagctcgctttcgcagcacatgcgcaagcacacgggcgagaagccctacaagtgtccctactgcgaccaccgggcttcccagaagggcaacctgaagattcacatccggagccaccgcacggggactctgattcagggacacgagccggaggcgggcgaggcgccgctgggtgagatgcgcgcctccgagggcctggacgcctgcgccagccccaccaagagcgcctctgcctgcaaccggctgctgaacggggcctcgcaggccgacggcgccagggtcctgaacggggcctcgcaggccgacagcggcagagtcctgctgcggagcagcaagaagggggcagaggggtccgcatgcgccccgggggaggccaaggcagcggtccagtgctccttctgcaagagccagttcgagcgtaagaaggacctggagctgcacgtgcaccaggcgcacaagccgttcaagtgcaggctgtgcagctacgcgacgctgcgggaggagtcgctgctgagccacatcgagagggaccacatcaccgcgcaggggcccggcagcggcgaggcctgcgtggagaacggcaagcccgagctgagccccggggagttcccgtgcgaggtgtgtggccaggccttcagccagacctggttcctgaaggcgcacatgaagaagcaccggggctccttcgaccacggctgccacatctgcggccgtaggttcaaggagccctggttcctcaagaaccacatgaaggcgcacggccccaagacgggcagcaagaacaggcccaagagtgagctggaccccatcgccaccatcaacaacgtggtccaggaggaggtgatcgtcgccggcctgagcctctacgaggtctgcgccaagtgcgggaacctgtttacaaacctggacagcttgaacgcccacaatgccatccaccgcagagtcgaggccagccgcacgcgcgccccggccgaggagggggcggaggggccctcggacaccaagcagttctttctccagtgcctgaacctgaggccgtcggcggccggcgactcgtgccctggcacgcaggccggacggcgggtggctgagctggacccggtcaacagctaccaggcctggcagctggccacgcggggtaaggtggccgagccggccgagtacctcaagtacggggcctgggacgaggcgctggccggggacgtggccttcgacaaggacaggcgcgagtacgtcctggtgagccaggagaagcgcaagcgtgagcaggatgcaccagccgcgcaggggcccccgcggaagcgcgcgagcgggcctggggaccccgcgcccgccggccacctcgatccccgctcggccgcgcgccccaaccgcagggccgcagccaccaccggccagggcaagtcctccgagtgcttcgagtgcggcaagatcttccgcacctatcatcagatggtgctgcactcacgcgtgcatcgccgcgcgcgccgcgagagggacagtgacggggacagggcggcgcgggcccgctgcggatcactcagtgagggtgactcggcctcccagcccagcagccctggctccgcctgtgccgctgctgactccccgggctctggcctggccgacgaggctgccgaagacagtggtgaggagggcgcccctgaacctgcaccagggggacagccgcgccgctgctgcttttccgaagaggtgacttcgaccgagctctccagtggagaccagagtcacaagatgggagataacgcctcggaaagagacaccggcgagtccaaggcagggatcgcagcttctgtgtccatacttgaaaacagtagcagagagacttctagaaggcaagagcagcacagattttctatggacttaaagatgccagcatttcaccccaagcaggaggtgcccgtccctggtgatggtgtggagttcccttccagtacgggagcggagggccagacgggtcaccctgcagaaaagctgtccgatttgcacaacaaggaacactctgggggagggaagcgggcgctggccccagacctcatgccgctagatttaagtgcgaggtcgacgcgggatgaccccagcaataaggagacggcctcctccctgcaggcggctttagtcgttcacccgtgtccttactgcagccacaagacctactaccccgaggtcctgtggatgcacaaacgcatctggcaccgtgtcagctgcaactccgtggctcccccgtggattcagcccaatggttacaaaagcatcagaagcaatttggttttcctttcccggagcggacgcacgggccccccgcctgccctcggtggcaaagaatgccagcctttgctccttgctcggttcacccgcactcaggtgccaggggggatgccggggtccaaaagtggctcttctcccctgggagtggtcacaaaagccgctagcatgcctaagaataaggagagccattccggaggtccctgcgctctgtgggcgcccggccctgacgggtatcgacagaccaaaccttgtcacggccaggagccacatggcgcggccacacaggggcccctggccaagcccaggcaggaggctagctccaaaccggtgcctgccccgggtggcgggggcttcagcaggagcgccacccctacgcccaccgtcatcgcccgggctggcgcgcagccctcggccaatagcaagcctgtggagaagtttggggtccccccagcgggggctggctttgcccccacaaataagcacagtgccccggactccctgaaagccaaattcagtgctcagcctcagggtccacctcctgcaaagggcgaagggggcgctcctcctctacctccccgcgagcccccctcgaaggcagcccaggagctgaggactctggccacctgtgctgcggggtccaggggcgacgcggccttgcaggcccagcccggcgtggctggggcgccccccgtcctacactccatcaaacaggagccagtggccgaggggcatgagaagcgcctggacatcctcaacatctttaagacgtacattccaaaggactttgcgaccctctaccagggatggggtgtcagcggccctgggttggagcacagagggacactccggacgcaggcccggccaggagagttcgtctgcatcgagtgcggaaagagcttccaccagcccggccacctcagggcccacatgcgggcacactcagtggtgtttgagtccgatgggcctcggggttctgaagttcataccacctccgcagacgcccccaaacaagggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaatacatgtagatactatatacgcatttacgtgctcatcgtccatagtcccatattttcttataataaacagtagtactggcaggcacagtaggggcacaaggcatctgtcttattcaagacaagtttgagacactggaaaaaaagatacttgttgtgtgtgttggacagagtggcgaggctgagcactgtcacaggggcctcccatgttaagagggactgtggggatgatgtcagaacaagacgtggtggatttgaggttgatcgagtattaatactactgcctctccttgtcttagtgggtatttaaaatagtaaataagagagaggaaggaggtgacgttcaggtgctgtgggaagcaggcttggcggaggggtatgatgatgagaccctcattgttcactggctccatcgcactcctccctggggccgtgtgcctgttccattcttcccaccattcgaactgagcgaatctggcaaaggagacacgtctgtgggaatgcgtagattccgcctcggaagagagctagcgcaacactaagaaaagcaggcttcttgtttattctcaggacctttttgtaacagggctacattctgcaaactgcttacaaaggaagactatacgtcttaacaaattatttagccactgagtcctcccgattcggacctgttttagtaatggcagaagaatccctgagcaggttcaggtgccctagatgactagggtgctgagctctggcgccttctgtccccactctttgcctccccgccccttccctgagccaccccagcaagtgggtgtcttttctccctgggcctggtgacctccacaggatgagtgactttgttcataaagggtggggatcaccagccccttgggtgggggacggcttcatatacctcttcctcagtaatgcaaatgcgagtttttgtggtgggggttaaggcccataacaaaggatcttaaaccatgcagtgtacgcaattgaaatggtattccacagatataaatattttcttttcccattgccgtgacactatgtgtgatggtaatatttctgagagtttcagatttttgcacatatgattttatgcattatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattattattgttattgttattagtaatgtttggttctggattctacttgttactgagtttaaattacttgacggttcaggttactttgcaacactttcaaacgatgcaatgtaactggctagcttatatatatatatatatatatatatatatatttttttttttttttttacttatttttttctgatattcttacaccagatatgtacgaaaatgatctgtcctgttggtgtaattaggaatgtccatgcagatacagttaaacaactgtaattgactgttctgtaaagttattttgggcaaagttgcggagacacattcctctgtccacctaagaaatcagaagactcttctgttgatttatgtttaatcatttcagtagtttccccacagtgatcatttctgcattttctggcttttgttttcttggctgaaagtgaatggtgactgttaggaatgtcagggactagtgacccagtcctgtttctctgtgttttagttattaaaaagaaattctgtacccaaagtg

SEQ ID NO: 1512 - DNA, 4564 bp, Homo sapiens
ccggggccctacacgccagacctggctcggggtgggagtgcagaggcaaccaaaaaggaacccacacctccctccagggcccggggcgctgtcagacggggcagcaaccaggagattccctgggcctgcaggaagcccttccgcggaccgaaagattgttccccattttggagatgaagaaactgagactcaaagcagctgagtgaccttcccaaggacacacactgaactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggtgctgccagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacagtcacaaaaatgtctcatgggaaagccttgccagattcagacacatatatacaatttcctaaccagcaaggcccccatacaccatctattccataaaccactcaggttacagatgcatgctttcctatttctaactctacacataaacttttactggaagtactcataattggacattccagcaacctgctacagtccccacccttgtgtgtcttgatacagacacaccaagtttctgtgcctctgacccctcacctgtgccaagatgtttaaagtgtgatggttcaaaattcattgaaagctcttttcttgtaactcatgacaaagtccgtcctcattgccactgagaggtgtttaatgtgatccaagacctctctgtgaaacattacccccgcaaaccactcagcaaagtgcctttctccaagcaagaacaaagagctcttggtggtgactgctagaaaattatggaagcccactcatttatgtcagtggactgcaactgtgtacctgtgcaatgtttacagatggaaagggtgaggagatgctacacctgagctaggtatctcctatataaccaaagtttccagcagggaaggaactagacaatcatcagtgcagtctcacagaaggcaacactggaagtgatgtcataaggttgtgatgtgtgcacggtatggcacaggtgggatgcagaggtaacagagtttaaatgaaagtaggatgaagctataaagaggtttatttatatttatattgaagctcaggcaagtgccttgcacacagtaggtacttataactaactgtggttactgttggatatgtgatgttgttaagggtaagcttgtaatacctcaccagttctccccgagtgatcttctcttctaagtgagcccactaattgctgcaatggatgaaattgggtgtttaatgctggagagcacatgtaggtgacacatgtgccttgaggtatgtgaggacatgtaaattagatccacagtgagctgaggagggctttccccgccagagtgaggttgggaagcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattctatttgctcacttgggctgcttggtactcacctgccctccaggtgtactttaggcctgtggagggtgggcatttagtggtgacccttgcaccagggttttctaacagatgaccctgtgaatcataatttaaacctgcatatattttatagccagtcacatttgccctctcaccctatatggccataaactgcctaagcactcaggcctcccactcatcaacccctttgaccagagaaagaagcactctggttctctatccccttgtcacatagagagtttgtcatggggcctctggctgtgcccttcacataacagaatgacttgccatctgcctgcaccaaacccagggatgtggaagacatctccccacaactgccactgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcacttccacagccgatgactcagaagagccaaacccagaatggggcctctcttttccccatcacagactcccctgacaacctttcctggcgtaactagaggagtcccagtgcaggataggccctaaacgttttgttaaataaacaggtgcatgaaaggagcctaaggccattgttgatatccactctcttctttccacttccttctcatctttttctccatgttttatgcttctctgattccctcttctgcctgcaccagaccagccccagccctttattcctctccattttcactccttccagcctctgtccctgaactgccactggcaacccatgggacctcaggaccagagactgcttgactcatctggggagggtaagttcacgggggacaaaaaaatgattcctaaagaagaggcttcctagaccagcacaggctcgagaaagacatcccctaggcctggacttctgagcagctttagccaggctccggacggcagccagaggaggcctttccccattgctcctttccccattgctcaatggattccatgtttctttttcttggggggagcagggagggagaaaggtagaaaaatggcagccacctttccaagaaaaatataaagggtccaagctgtatagtatttgtcagtatttttttctgtaaaattcaaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatatactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtaagtgtgtgtacactgttcaatatggttcaatatggtaccaatagccacatgtgactatttaaattcattgcaatgaaataaaattaaaggtatactagctc

SEQ ID NO: 1513 - DNA, 5285 bp, Homo sapiens
gatgtcttggacatgctctggctggctaatctccatgttctagccgactgaaaatacggtggccaagtggatggtgtgcttatttgcagtctaaagaaatttccttttgatgtggcagaaaatcgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgatctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatg

SEQ ID NO: 1514 - DNA, 2681 bp, Homo sapiens
cggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgctttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 1515 - DNA, 1219 bp, Homo sapiens
gggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtcggcaagtcatattgcttctaatccaaaagcaagtgcaaaaacgaaaaaggacaacatgaaatatgctagttgggcagctagtcaaataaacagagcttatcagtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaacttgc

SEQ ID NO: 1516 - DNA, 6471 bp, Homo sapiens
ggtcaacaaggacctcactgagaagcttgaggccctggaatccctgcggctacaggagcaggcggccctggagacagaggatggagaggggctacagcagaccctaagggacctggcacaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcaggtgagcagcatctcgccaccctgccaggacccttcagatgtgcctcgggtcccctgacagtgcccccctggggttaggtgacacccactgggtcctgggcctcctaccgtctggacccctccgatgtcgggttttctaaccagacccatttcaggaaactggggctcagggaggtatagtcacttacctggagtcagagaactagttaaaaggtagaacttggatgataataacaagaataattaaaataacagtagtaatattagcagtagtattttaaaaatttagttagaagaataataatatccttactaatttcactaagtgccagataccattttaagcaattcagttctctcatttaactccatgataactctgtgacatagaagcggttatctccattttgtggatggtaaactgaggcacagagaagccatgtcacttgccccaggtcacacagttagcagaagagccaggatttgaacccagacattctgccttcagagttaacctcttcaccactgcgctgcttacctctcagggacgtgatcgatgatgatgtttagtagactgtggtggagcatgttattcttgtttctgaaggtccttggggagatgtgtcaggcactattttaagcacatgtgaagtttgtatccttaaaacaggccgggcgcagtggctcacgcctgtaatcccagcactttgagaggccaaggcaggcagatcgcctgaggtcaggagttccagaccagcctgaccaacgtggagaaatcccgtctctactaaaactacaaaaattagtcaggcgtggtggtgagcacctgtaatcccagctactcgggaggctgaggcaggagaattgcttgaacctgggaggcagaggttgcagtcagccaggatcgcaccactgtactccagcctgtgtgacagagcaagactgtgtctcaaaaaaacaaacaatgtcacgaggtaagtgttacctcattttgcagatgtgaaaacggaggcccagggtcatggagctaagcggtagtgggcttggttgccctgtggctcaggctgtttctctccaaactcctgcctcaggcctggtccccagcccagcatctcgctggctacaggaggttcggggcaggaaagtgacatgggccacccacccaccctttgtcccacagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcgcttggagaaggaagccctggagggcagcctgtttgaggtgcaacggcagctggcccagcttgaggcccgccgggagcagctggaagccgaggggcaggccctgctgctggccaaggagaccctgactggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggccttgtctctgaaggagtctgagaagacggcgctgtcagagaagttgatgggtacacggcacagcctggccaccatctccctggagatggagcggcagaaacgagatgcccagagccggcaggagcaggaccggagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggcagaagagcttcggacccagctgcgtctgctggaggatgcccgtgacgggctgcggcgggagctgctggaggcccagcgcaagctgcgtgagagccaggagggccgggaggtgcagcgccaggaggcaggcgagctgcgacgcagcctgggcgagggtgccaaggagcgcgaggccctgcggcgttccaatgaggagcttcggtctgctgtgaagaaggcagagagcgagcgcatcagcctgaagcttgccaatgaggacaaggagcagaagctggcactcctagaggaggcacggacagctgtgggcaaggaggccggggagctgcgaactgggctgcaggaggtggagcgctcacggctggaggctcggcgggagctgcaggagctccggcgtcagatgaagatgctggacagtgagaacaccagactgggccgggagctggcggagctgcagggccgcctggcgctgggcgagcgggcagagaaggagagcaggcgggagaccctgggcctccggcagaggctgctgaagggcgaggccagcctggaggtgatgcggcaggagctccaggtagcccagcggaagctgcaggaacaagaaggcgagttccggacccgcgagcgacgcctgctgggctccctggaggaggcgcgtggcactgaaaagcagcagctggaccacgcccgcggcctggagctgaagctggaggcggcgcgggccgaggccgcagagctgggcctgcggctgagcgcagccgagggccgggcacaaggcctggaggccgagctggcccgcgtggaggtgcagcggcgcgcggcggaggcccagctgggtggcctgcgctcggctctgcgccggggcctcggcctcggtcgcgcgcccagcccagccccgcggccagtgcccggttcccctgcccgggacgcacccgcagaaggaagcggggaagggctcaacagccccagcaccttagaatgcagccctgggtcccagccaccatctccaggacctgccacctccccagcctctccagacctggacccggaggcagtgcgcggggccctccgggaattcctgcaagagctgcggagtgcccagagagaacgggacgaacttcggacccagaccagtgccctgaatcgccagctggccgagatggaggctgagagggacagcgcaacctcgagggccaggcagctgcagaaggcggtggctgagagtgaggaagcccggcgcagtgtggatgggcggctgagcggggtccaggcggagctggcgctgcaggaggagagtgtgcggcgcagtgagcgggagcgccgggccacgctggaccaggtggccacactggagaggagcctgcaggccaccgagagcgagctccgggccagccaggagaagatcagcaagatgaaggccaatgagacaaagctggagggcgacaagcggcgcctgaaggaggttctggacgcctccgagagccgcactgtcaagctggagctgcagcggcgctcgcttgagggggagctgcagcgcagccgcctgggcctcagtgaccgcgaggcccaagcccaggccctccaggatcgggtggattccctgcagagacaggtggccgacagcgaggtgaaggcagggaccctgcagctgaccgtggagcggctgaatggggccctggccaaggtggaggaaagcgagggggccctgcgggacaaggtgcggggcctgacagaggccctggcccagagcagtgccagcctcaacagcacccgggacaagaacctgcatctgcagaaggctctgaccgcctgtgaacatgaccgccaagtactccaggaacggctggatgccgcccggcaggcattatctgaggcacggaagcagagcagctccctgggcgagcaggtgcagacgttgcgaggcgaggtggctgacctggaactgcagcgggtggaggccgagggccagctacaacagctacgggaggtgctgcggcagcggcaggagggtgaggctgcagccctgaacaccgtccagaagctgcaagacgagcggcggctgctgcaggagcgcctgggaagcctgcagcgcgccctggctcagctggaagctgagaagcgggaggtggagcgctcagccctgcggctggagaaggaccgtgtagccctcaggaggacgctggacaaggtggagcgggagaagcttcgtagccatgaggacacagtgcggctgagcgcagagaagggccgcctggaccgcaccctcacgggggctgagctggagctggcagaggcgcagaggcagatccagcagctggaggcgcaggtggtggtgctggagcagagccacagcccggcccagctggaggtggatgcgcagcagcagcagctggagctgcagcaggaggtggagcggctgcgcagcgcccaggcgcagactgagcgcaccctggaggctcgggagcgggcccaccgccagagggtgtccacactgaagggccagctgcagcaggagcttcgaaggagctcagcacccttctccccaccctccggccccccagagaaatgagctcctgctggcatctggagaacacccctgtgcctgggacaggggaggacccttcttttggacagcccccccccccagagcccggtcccttgggggcctcaagctggggtgggatgaggaggcgctctgctggcagtgctgaggacgggtactccagctccaggcctggagaggcttcccagcaacacctgcagtccagcccccctcttctaggatgagccactgtagatcattaaagttcctccttgagaggctgagccgtagccaggattggggagagcccttgtctctggtcagccctggagcatgggatcgtgggaaagaggagggggaccaggcccagggcaggggtcagaggcccaggccctgacttcggcttcccagagatctctccgccttagttaagagcatgtgtcgggaaattcctcagagtgctcagagtccctgtatttttatacctttttacaatgttaactgttcagaactgttttttgtaacaaaaccttgttttt

SEQ ID NO: 1517 - DNA, 2913 bp, Homo sapiens
acgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaacagagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatataaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatttg

SEQ ID NO: 1518 - DNA, 6962 bp, Homo sapiens
cgcgatgggcacctgcagcatcggtctggggagaacagcattcgagctgccgggtggcttgtggtccggttggccaccaagtggtgtcagcggaagctgcaggcggagctaaagattggctccttccgctttttttggatccagaatgtcagtcttaagtttcagcaacaccagcaaacagtggaaattgataacctgtggatttccagcaaactccttagccatgatcttccagcgctggggtggatcaaaaggaactgtccttcagcccatccttattgaagatcttctgccaactattctccattcatgtagatgctataaacatcatggttctcaaggtggatacctctgagtccttatggcatattcagatcagtagaagcagatttcttttggatagtgatgggaaaaggctaatctgtgaggtgagcttatgtaagatcaacagcaaagttctaaagagtggtcagctggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcagaggtgacagaaaacttagttgagccaactctgcctggcctattccttctccagcagctgccagaccaggtcaaggttaagatggagaacacaagcgtggtattgtccatgaatagtcaaaagaggcacctgacttggactctgaagctgctgcagttcctgtaccaccgtgatgaggatcagctgccccttcgaagcttcacagcaaactctgatatggcacagatgagcactgaactgctgctggaagatgggttgttgttgtcccagagtcgccaacgcattgtctgcctcaactccctcaaggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatctccaatgtcaacatttccattcaacttggagatacaccaccttttgccttgggattcaattctatctctctggattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacagggtagctataaccagcctctgggcctgtccagcacccagtcagataccctttttcttgattgtaccattcgaggacttcaggtggaagcatcagatacctgtgcccaatgtctgtctcgtatcttatccctgatgggtccacaatctgggaagtcagctgtctctaggcactcttcatttggggaatctgtgtcattactgtggaaggtggacttgaaggtcgaagacatgaacttgtttaccctttctgccttggttggtgcttcagaggtacgactggacaccctaactatcctgggcagtgcagagacgtccactgtggggattcaaggacttgtgttagcgctggtgaaatcagtcacggagaagatgcaaccctgttgcaaggcccctgacatccctaccccagtgctcagcctttccatgctctccatcacctatcacagcagcatccgctctctggaggttcagtgtggtgcagggctgaccttactttggagccccccagatcacatgtacctgtaccagcatgtcctggccactctacagtgccgagacctactaagagccactgtgtttcctgagactgtaccatcccttgcactagagacttcaggaactacttctgagctagaaggccgtgcccctgagccattacccccaaagcggctgctaaacctaaccctggaggtgagcacagccaagctcacagcttttgtagctgaggacaagttcattaccctggctgcagagagtgtgtcactgagccggcatggaggttccctgcaggcatactgtccagagctggctgctggctttgatggcaatagtatcttcaacttcaaggaggtggaggtgcagctgctacctgagctggaagagatgatcctccaccggaaccccttccctgcgctgcagaccctccggaaccgtgtttggctcctctctttcggctcagtctcggtggagtttccttatcagtatgacttttctcgaactctagatgaggctgtgggagttcagaagtggctgaagggactacatcaagggactcgtgcttgggcctctccaagccctgtcccactcccacctgatctactcttaaaggttgagcacttctcatgggttttcttggatgatgtttttgaggtgaaacttcatgataactacgagctgatgaaggatgaaagtaaggagagtgccaaaagactacagctactggatgctaaagtggccgcccttcggaagcagcatggggagttgttgcctgcccgcaaaattgaggagctctatgcctctttggaacgcaaaaacattgaaatctacatccagcgttcccgtcgtctctatggcaacacacccatgcgccgggcactgcttacttggagcttagcagggctagaactggtagctctggcagatgcctccttccatggtcctgagcatgtggtagaacaggttcaagagcttgatccaggcagcccttttccccctgagggattagatcttgtcattcagtggtgtcgaatgctcaagtgcaatgtcaagagctttctggttcggatcagggactatccacggtacctgtttgagatccgtgactggcggctaatgggtcgacttgtgggcaccgagcagagtggtcagccttgctcccgtcggcgtcagatcttgcacttggggcttccgtggggtaacgtggcagtggagaggaacatgcccccactcaaattctaccatgactttcactcggaaatattccagtacacagtggtgtggggcccatgctgggatccagcctggacactaattggccagtgtgtggacctcttgaccaagccctcagctgaccccagcccacctttgccctggtgggacaagagccgtcttctgttccatggagactggcacatggacattgaacaggcgaacctgcaccagctggccactgaggatccatacaacacaactgaaaatatgcactgggagtggagccacctgtcttttcattggaaacctggtcagtttgtgttcaagggtgacttggatatcaacgtgagaacagcctctaagtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaacaatatcccagccccgaattctgctatatagtagtaccctgcgctggatgcaaaacttctgggcaacttggacaagtgtcacaaggcctatctgcaggggaaagctcttcaataacctgaaacccagcaagaagaaacttggtcagcactacaagcaactttcctatacagccctctttccccagctgcaggtacattattgggcctcatttgcccagcaacggggcatccagattgagtgcagtcagggccatgtcttcactcgggggactcagcggcttatacctcaagcaggcacagtgatgcggcgccttatctctgattggagtgttacccagatggtgagtgacctaagtcaggtgaccgttcacctgatggcctcacccactgaagagaatgctgatcactgtcttgatcccttggtaacaaagacccacctgctgagcttgtcctccctcacctaccaacggcatagcaatcgcacagctgaggaggagctctctgctcgtgatggggatcctacctttcatacacatcagctgcacttagtagatttacggatttcctggacaactaccaatcgagacattgcctttgggttatatgatgggtacaaaaaggcagctgtactcaaacgtaatctttctactgaggccctgaaggggttaaagattgatccacagatgccagccaaaaagccaaagcggggtgtcccaactagtgcctcagccccacctcgtgttaacactcccagcttcagtggacaacctgataaggggtcatcaggaggtgcttacatgttgcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcagatggttcttcgtggagcagagacagaaggctgtgtcattgtgtcagctgccaaagcccaactgctgcagtgccagcaccatccagcctggtatggtgatacattgaagcaaaagacatcctggacttgcctcttggatggcatgcagtactttgccaccactgaaagcagccccacagagcaggatggccgacagctctggttagaggtgaagaatatcgaggagcaccggcagcgtagtctggactctgtgcaggagctgatggagagtgggcaggcagtgggcggcatggttaccacaaccacagattggaaccagccagctgaggcacagcaagcccagcaagtccagcggatcatttcgcgttgcaactgccgaatgtactatattagttacagccatgacattgatcctgaactagcaactcagattaagccacctgaagttcttgagaaccaggaaaaggaagatctcctaaagaagcaggaaggggctgtggataccttcacccttatccaccatgagctggaaatttccaccaacccagctcagtatgccatgatcctggacattgtcaacaacctgctgctccatgtagaacctaagcggaaggaacatagtgagaagaagcaacgggtcaggttccagcttgagatctctagcaatccagaggagcaacgcagcagcatactgcatttgcaggaggctgtgcggcagcatgtggcccaaatacgacagctggagaagcagatgtattctatcatgaagtctttgcaggatgacagcaagaatgagaatctgcttgacctgaaccagaagcttcagttgcagctaaaccaggagaaggccaacctgcagctggaaagtgaagaactgaatatcctcatcaggtgttttaaggatttccaactgcagcgggctaacaagatggagctgcgaaagcagcaagaagatgtgagtgtggtccgtcgcactgagttttactttgctcaggcacggtggcgcctgacagaggaagatggacagctgggaattgctgaattagaactgcagaggttcctctacagcaaggtgaataagtctgatgacacagcagaacatcttctggagttgggctggtttaccatgaacaacctcctccccaatgctgtctataaggtagtactgcggccccagagctcctgccagtctgggcgacagctagctctccgcctcttcagcaaagttcggccccctgttgggggtatctctgttaaggagcattttgaggtaaatgtggtgcctctcaccatccagctgacacaccagttcttccacagaatgatgggctttttctttcctggccgaagtgtggaagatgatgaagttggtgatgaagaggataagtccaaactggtgactactggaataccagtggtgaagcctcggcagctgattgcaacagatgatgcagtaccactgggccctgggaagggtgtggcacagggtttgactcggagttctggggtcagaaggtcatttcgcaaatcgccagagcaccctgtggatgacattgacaagatgaaagagcgagctgccatgaacaactccttcatctacataaagattccacaggttccactgtgtgtcagctacaagggtgagaagaacagtgtggactggggtgaccttaacctggtgctgccctgtctggagtaccacaacaacacatggacatggctagactttgccatggctgtcaaaagggacagccgcaaagccctggttgcccaggtaatcaaagagaagctaaggctgaagtctgcaacaggctctgaggtccggggaaagctagaaactaaatcggacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatat

SEQ ID NO: 1519 - DNA, 7724 bp, Homo sapiens
gtgggggacaatgaggatgcaggcacactgggcaagagggggttaaatgtcaggcaggataggtctgattgatggtactgggtgggcatcttatctcactgctgcaccatccccaggggtacagaaaggtctgaatgaatcccatgttccctagccctacagctgggcacgcagtaggggctcaggagatgctgtggaatcaatgaccagatgctgaatgagtccctcatggaaaaagctgatgcatggggcctctccttgcccctggagctagaggtaggagtcagggaaccccagagacatgccagctcagcaaggctaggccaaggaggatgggggtggttgtggaagcccagggtgattctcagtgtcctctggtcattgctccctcgtcctgtgaactttctctgagctcccactctgtaccaaggagaccctgtccacagtgagttggatactgccagtcccaggaggaagtagcccagtattggcctgtccaactgtgcccgttaagaggccatagtgcttccgtgctggttgaccaagagctgttatcccacagccccaccccctagggctgcagtttcacccccaaagccccagcagatttggctctctcccttcccctcccacacaaaccagccagtaaagagttgagagctgatagagtggcggcctccaggaccccaccctagggcagattctaactgcttgagactgatgatgagataatttgcagtgtcatccttgtgtctaatgtgagatgaccttgatttgaagtgtctggtgtcttgtcactgccttgcatatggttctgaccagtcaggcaggctgggactgaaggtggctccctggtgaacctagcgctgtgggagttcatagtagaatcggcttaggtgctgccacccaactcaactccactccctccctttctctcttctgcaggcagccatgagctccagccaccccgagccgggtccctgggcacccctgagcccccgccttcagcccctgtcccagagctcttccagcctgctgggtgaaggccgggaacagaggccagagctccacaagactgccagcagcaccatgtggcaggcccagctgggcgaggccagcaccagaccccaggccccggaggaagaggggaacccgcctgagagcatgaagccagcacgggcctctggccccaaggcgcgacccagtgctggaggccactggcggagcagcactgtgggcaatgtgtccaccatgggcggtggtgacctttgtcgcctgcgggcccctagtgctgctgctatgcagaggagccattcagacctggtccgtagcacccagatgcggggacacagtggtgctcggaaggccagtctcagctgctcagcccttggcagcagccctgtccacagggctcagctgcagccaggtggtacttctggccagggtggccaggcccctgcaggcctggaaagggacctggctcctgaggatgagacttctaactcagcctggatgctgggggcgagtcagttgtcggtgccaccactagacctgggggacacaactgcccacagcagcagtgcccaggctgagcccaaagctgctgaacagctggctaccaccacctgccatgctctgcccccagctgctctactctgtggcatgagggagatgagggaggtgggggctggtggctgctgccatgccctacctgccacagggatcctggcctttcccaaactagtggcgtcagtgagcgagtctgggctgcaggctcagcatggggtgaagatccactgtaggttgtctggggggctccctgggcactcccattgctgtgcccacctttggggtcccgctgggttagtcccagagcctggctctaggaccaaagatgtgtggaccatgacctcagccaatgacttggcccctgcagaggcatccccgctgtcagcccaggatgctggtgtgcaggcggccccagtggcggcctgcaaggctgtggccaccagtccgtccctggaagcgcctgcagccctgcatgtgttcccagaggtaactctggggtccagcctggaggaggcgccgtcccctgtgcgggatgtgcgatgggatgctgagggcatgacatgggaggtgtacggagctgcggtggacccggaggtgctcggtgtggccatccagaagcacctggagatgcagtttgagcagctgcagcgggcgcctgccagcgaggacagcctgtctgtggagggccggagggggccgctgcgggctgtcatgcagtccctgcggcgccccagctgctgcggctgctctggcgcggcccccgagtgaggagctgtggcccttggagctggcctgggcccactgacttagtcctagacctgggccagggacagtgggggctccgtgccccctggacccaccggcagctgggcacatgtctcacccgaatatcggctgcctccagaccacaggactgcagcctggggcttccggccccacacagctgggctgttttcttaagggcttgatttccaagggccacatctctgcaccttccaggctctgaactttgagacagggctttagcactgtgcagaggggagatcctgagttttctttaaaaaatgaccttttgttcactccaccctcagaactctgccatgttgcctcgtcagactcttggtggctttatttgaaatcagtgctgagaaatagtgaattctcgacatgaaatgtgaggccccagtgacagggactgcccaggtctttagggaaggggactgatgttatcagaggcctcctgtgtgccacatactgtgcttgtcctgtcttcacctcttcatcctggcaagccttcatttggcaaggctgtagccgatgtgccccacgctggacagcttgaagaggtgggactgagatccaaagccagggccggctgagccgagggtgttgccctgtagcatgtgcccggtccagtcagtgcagtcatgtatgaggagaatttactgagctcatactctgtgctgggttctgtggattctgtggtgaatgagacagaggctgcccctgccctggctgagctcatggtgtgggttggggatgacaggggaggatgctgaccattacggagggctgccaggcttccagggtcattgtgtcagaggctggtctgaggaaggggagaatgggtggccacctgccctaatctcagttacaaagcctaaaattgcactattttcacctcattctgtcggctgaaggatttctccccagctggtgcagtttgtggaaggagggagggcaggaatggagggggacagggcaggagtttgccctggccctggggtaggggctgtgaggctgtggggctcgcttgcccacatgacctgacctaggctaggcagtgggggccaggggccttggagagacagaaacatgggggtttggcacagtctgacttcattgcccaaagatttctcaaggcctgtgaagaatgggagtgggcttgtgttcttgtcctgggtctttgtcttgaagatcctaagatcccgtgactcagccccccaatccacccttgtgagggaccagagggctagtgtggggtcatggcccatgacctggcctgtttctggagcctcttctgcacctaggagcccaggacccccacagtggtggcttacttttccccatcctcaaggacctggtactcattgaggtggaaatgactcatgcaacagttggtgaatttgtaaagcaggagtggcatttcaacaggccacaaggacaaagtgacaaaggcgtgcgtcaggtcagatgcctcctgaagcccaacgatggaccattctcacccgtaaacctgcctttcccatatgcataggtgcaccccttgggattctggggctgtcagtccctttgtgtatggtgccagggcaggcagctcacgttctggggagtgacacatgggtatatgccatcttcatgcctggctccccatggagtctccaggaaccccagcctgttagggtcacatgagagagaacaaatggctgtgggtacatggggagggacctttcacacagggccatagctaagtagggtcttgaggatgcaggggttagacaggtgggtggagagagggcaggacctgcccggcagatggaacagcctggtcagatacttggatgtgcctgtcctgcccgggccatgatgagtttctgcagtggcggctcatttggagcgtttgttgggttgggaggtgaccaggggtccccattgtgaagatcctgatgtaaatgaggaaaggaactttaagggaactgtggaaggggttctgaggtgggaccagatttcagtttagaaatatccatttggcttccagtggagatgtgccaggtgacaccaaggaggggcctgtttaggggcaatggagtgggcagctgggggctgggttcatacacgtgcacacacacgcatacacaggcacacatgtgtgcaatggatttggggaggaggcatttcaggatgctgaggtttccagtttgagcaagaggagggtgaggccactacctgggacaaggtgaatggcatgttcagcaggtgcagaaagggccacatgccacagggtttggctgggaccagtgaaacctacttcatgaagagactttcttctgtgtcacatgcagattctcatgcattcacgctggctgggtgccactctgtgctacctccatgctgccctggcttgccaggatggcaggccgggctgggctcagccaagctcccactcacctcatcatcactgagatgagtatttgcagagcggtgctggaatccaacacctgtgtcttggctggggccccagacgattctcctggctaaaccacgatccttgtctccctagcccagttgcacagctgctgctgacaggtctacctgaagtgactgcagcctcatttctgattggaactggagacccctcccaaccccccttgctgtgccctctcctgggacaggcctgatgcctgcagtggtttagggccccagagcatggccagcggtttagtttacagatctcctccccttggactctagatttctggccagactttctgggtccctttcaggccctgctctgggaggtgttggagttcactgttgatgtgtttgtttggctttgaattcaaaatagatacaaatttggaggtgagagctttgccagaccccagcagggatggggcatcggtcctggctggtcttgtttattttgtcctggtaaattctgttctctggagcataaaccgtggagtcctagagccccttgtctcagcaggaatcccccctctgtctgctccaggggctccctgcttctgcccacctgctctccttccatggcattcaggacccccgacagctgaagcctctcttcatatagcttgtcccctctgggcctgcctgtcttgtgtccaggacacaagacacgcatcccttgtctggccccaggctgccatcactgtcacaagaaactcatagagtagagctggtctgaggtcacagtgctggtggtggtggaaaagcagggatggcctgttccactgtgatcttacctcctgtgtcacctggattgggtctctgtccccttagacatgctagatcctaactttacaagggctgaaggggtcttctacatgcaggtcccaacactttgggctggggttggccaccgtagcttagtgggctaaagctggagtttgaatctggatatataggatccacacctatagccatgtgatcttgggcaagttacaagccttgatcatcttcctcatctgtaagatggggatgacaatggtgcctccttcacatgcttggtgtggagattaaatagaataacccaagtagtgcctggcactgagttagtgctcagcacacaggctggtagtgttgggcacccctctcatagccacatttaggggccacctcttaccctgccagcttggctgtgatcacagcccacatcccacttccttaaaagtcccttgttcagagcctctttccaggttcctcgccccacagctttgcaccctgcctgggacttggccctctggctggggcttctgaaaatgtagttcccagagtgcactgaggagggctaccctagccctcaccactcatcttgggctgggttccccagaagcttctgctgagatgaggatgctggagttattagggaggggagagcaagttaagggagggacagaaggcaaggcagggtgtgatttcagtccaagccagaccctaaaggggagccctggatgcagtcccacctcagagtaaggactacccaggggtgaagatgtagcctccaggcacttctgctctctggcaggcaggctaggaagctctaggagccccagggtaggtttctgcatggagttgtagggcctattttgggggaagttgtgcacagaaaccaccagagggagtcacaggcatctgggggtgcacccattgacatttgcatccatgtcatgccaaacttgtagcccacaaatgcccaacccttttctccatgcattgctctgtctcagttttgttcacgccaagcagccttggttagttaaatgcagagcttggcatttgcccatgttaaattccttctcctttttcattctggcctggcctggttttgccatctgaagctatgatgagtcctttatcagttttcatccaacttgtcaggcagggcagggctggtatgaagcccaggacatatcgctgggacatcccataggtctgtgagattcccaggtccctccaaatccacacggtcatcatgggcaaattagtttaagtctgatctgttaagatccagatctctcacaccaacagcacacacccctttttcccatggccatggaaggagggtagcatagcctgactcgagtcctcgttctcagcagaactggttctgtggtggccacttccctttctcaacttttacctacttctgtttaataggttgttctgcaagtctgagagcaacggcaagcttagaagtgtggactcggcctggtacagtggctcatgcctgtaatcccagcactttgggaggctgaggtgggctgactgcttgagctcaggagttcaaaaccagcttgggcagcatggcgaaatcccatctctacaaaaaatacaaaaattagctgggcatggtggtgtgcatctgtagcctcagctactcagggggttgaggtgggaagatggcttgagcccaggaggtggaggttgcagtgagccgagatagtgccactgtgctccagcctggatgacggagccagatcctgtttcaaaaaaagaaaaagacaagaaagaagtatggactctaccttcttgcccttgtggagattgggaactgcctgcccttggcctctttcctgtccatcttgtattatgaaaggctgtttctggcacacccgggctcctctgtgtggtttctgggaagtgactgagggtcaggggaatggagcccctctgcagccggccgctggtaccttccctattgaacccttctttaggcttgctcactctttttgatgggtgtctttccaaagctggctggggacctccctgattgagagacatggggccagttctgttgctgtggctacacgggaataataaagcagaagaacacctgaggaaagctgatgtttact

SEQ ID NO: 1520 - DNA, 4080 bp, Homo sapiens
cgttagttctccgggtacctcaggcgcctcagcctccttagtctcctcatcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgccctccgcaccactagcctctcgggagcatggcgtcggccccgccggcctcgcccccgggctcggagccgccggggcccgacccggagccgggcgggccggacgggccgggggcggcgcaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtgaaggacttaactaagtacttggatcccagtgggctcggcgtgatcagctttgaagacttctaccaagggatcacagccatcagaaacggagatcctgatggccagtgctacggtggtgtcgcttctgcccaagatgaggagcccctggcctgcccggacgagttcgatgacttcgtcacctatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcaggagaacctgcagctggtgcacagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggctacagcaactggacgaggagaacagtgaactccggtcctgcacgccctgtctgaaggccaacattgagcgtctggaggaggagaagcagaagctgttggatgagatagagtcgctgacgctgcggctcagtgaagagcaggagaacaagaggagaatgggggacaggctgagtcacgagaggcaccagttccagagggacaaggaggccacccaggagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggacaaccgcaacctgaaggagcagaacgaggagctgaacgggcagatcattaccctcagcatccagggcgccaagagcctcttctccacagccttctctgagtccctggctgcagagatcagctccgtctcccgagatgagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatat

SEQ ID NO: 1521 - DNA, 6476 bp, Homo sapiens
cactgactggactgaaaacagggccaagaaaactgctgctgcagggggtcctgaaaacagctggaacccggcagtgatgtgggacctaacttgaagttaacctgtggtggtgaggttggaaccagttggattatgatttattttctacactcttgtacggaatgcagagctgttgtatcctgatgaatctactgctaaatatagtcatttggaataattttaagtattgatcttaaaacttgtaccacaacaagagtgtctaaaaagcacggcaagctcattacgttcttacgaacattcatgaagtctcgtccaacaaaacagaagctgaagcagcggggaatcttgaaagagagggtgtttggttgtgacctgggggagcaccttctaaattctggttttgaagtgccgcagttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgttgatgtgctgttcagcggcagaatcagcatggccatgcaagagggggcagcttctctatcaaggcccaagtccctcctggtatcctctccatccaccaaactgctgacattggaagaggcccaggcacgaacacaagctcaggtcaattctccaattgtgacggaaaataaatatatcgaagtaggagaaggacctgctgcacttcaggggaaatttcataccataattgagttcccacttgaaagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtggcagggcagaaggaaccctccgttcagctaaaagtgaggagtctcttacatctctccatgcagttgatggtgattctaagctcttccgacccagaagacccagatcttccagtgatgcactgtctgcctcttttaatggagaaatgctggggaaccgctgtaactcctatgataatctgcctcatgacaatgagagtgaggaggaaggagggctgcttcatatcccagcccttatgtctcctcattcagctgaggatgttgacttgagcccaccagacattggagtagccagcctggattttgatccaatgtcatttcaatgtagtcctcctaaggccgaatcagaatgtctggagagtggtgcttcctttttagattcaccaggatactccaaggataaaccaagtgccaataaaaaggatgcagaaacaggtagtagccaatgtcagactccaggaagcacagcaagctctgaacctgtctctcctcttcaggagaaactgagtccattctttaccctggacttgagcccaactgaagataaatcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggagcagttacccatgacccccctcaggattccgttcctgtcagttcagtctctcttatcccaccaccaccgcctccgaaaaatgttgcccgaatgttggcgctagcattagctgagtccgcacagcaagcctcaactcagtcattgaagagaccagggacctctcaggctgggtatacaaattatggagacatagcggtggctacaactgaagataatctgtccagttcttactctgcagttgctctagataaggcctatttccaaaccgatcgaccagcagagcagttccacctccagaataatgcaccaggaaactgtgaccatcctctaccagagacaacagctactggggatcctacccattccaacacaactgaatctggggagcaacatcaccaagtagacttaacagggaatcagccacatcaagcatatttatctggggacccagaaaaggccagaattacttcagttcccttagactcagagaagtctgatgatcatgtaagtttccctgaagaccagtctgggaagaacagtatgccaactgtctccttcttggatcaggaccagtctccaccccgtttctacagtggagatcagcctccttcttatcttggtgcaagtgtggataaactccatcaccctttagaatttgcagacaaatctcccacacctcctaatttacctagcgataaaatctaccctccttctgggtcccccgaagagaataccagcacagccaccatgacttacatgacaactactccagcaacagcccaaatgagcaccaaggaagccagctgggatgtggctgaacaacccaccactgctgattttgctgctgccacacttcagcgcacgcacagaactaatcgtccccttccccctccgccttcccagagatctgcagagcagccaccagttgtggggcaggtacaagcagcaaccaatataggattaaataattcccacaaggttcaaggagtagttccagttccagagaggccacctgaacctcgagccatggatgaccctgcgtctgccttcatcagtgacagtggtgctgctgctgctcagtgtcccatggctacagctgtccagccaggcctgcctgagaaagtgcgggacggtgcccgggtcccgctgctgcacctgcgcgccgagtctgtccctgcgcatccctgtggctttcctgcaccactgccccccaccaggatgatggagagtaagatgattgctgccatacactccagcagtgcagatgccaccagcagttcaaattatcattcctttgtcactgcttcatccacctctgtggacgatgcattgcctttaccacttcctgtcccacaacctaagcatgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattggttttcctaaattatcaactttctttcatt

SEQ ID NO: 1522 - DNA, 4318 bp, Homo sapiens
gcttcccggctgccaggctacagaactcgcctcgccactcctgagacatggacaacgccgttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcagtattagaaaggaagatatccacacgacaaagtagagaggagctgataagaaggggagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaagagaacactgaaaaccactctgaaacaccggcagctcctgctctacctccttctgctcctcctaagcctagatccaaacctaaacccaaaaaatcacctgtgcctccgaaaggggccactgctggggccagccacaaaggtgatgaagtgcctcccattaaaaaaaataccaaggctcctggtaagcaggcccccgtccctccacccaagccagcaagccgaaacacgacccgagaggctgctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatgtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggaggctgagccagaggcccacaactgaagaattagagcaaagaaacatcctaaaacaaaagaatgaagaagaggaacaagaagcaaaaatggaacttaaacgcagactcagcagaaagctcagcctgagacccacagtggcagagctacaagctcgaaggatcctgcgatttaacgagtatgtagaagtcacggattctcctgactatgaccgccgagcagacaagccctgggccaggttaacacctgcagacaaggcagcaataaggaaagaactaaatgaatttaaaagcacagaaatggaagttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagt

SEQ ID NO: 1523 - DNA, 5530 bp, Homo sapiens
ggcggcccctgcagggcagctgaagccatggaagcctccgcaggtcgctgatcagggccaggcggctgcagcagcgactgcagaggcgctgcgccaagccgggccggagtggtgcgagccggcggggctgcggagggccagtggactcagggttgttgagaggagtcaatggcataatacgggaagccccgaaccacgggccaactgggaagttgatggtcggcgagaccagcccatcctaatttggggttcctggtcctgctccaggagtcctacagcctgcagcccctaccagagagggaggactgaacagcaagggggtgtgtgggtctgagtatcagggtcctggggaagaagcaggcctggctcgtagagtagaagactcggtgccggcagtcaggaggccctgctcctgaagcctctgtgaccttgggcacggccttcactctgtctggggcacattcactcatctggagaacacagggttggactgattacttttagccactcctgacagttgtggttttaagttgggtggtgggaacctgtgcaccagccctattcaattcactggtggaggcagccgtggtctgccaggccctcgctcctggggtgtcctgccgaagggtgagaagagaagccatgccgggcagcggccccagcgagaggatgacgtggcctggcccggccctttctgcgggccccccaacccgccctctctcctcagcccccgggataccgcccatcccaccccttactcggacccacagcctcatggccatgtccctgccaggaagtagacggacctctgctggatcacgcaggcgcacctctccacctgtgagcgtgcgggatgcctacggcacctcttcgctcagcagcagcagcaattctggctcctacaagggcagtgacagcagtcccacgccaaggcgctccatgaaatacacgctgtgcagtgacaaccatggcatcaagcccccgaccccggagcagtacctgacccccctgcagcagaaggaggtgtgcatccggcacctgaaagcccggctgaaggacacacaggaccggctccaggaccgggacacagagattgatgacctgaagacgcagctgtcacgcatgcaggaggactggattgaggaggagtgccaccgcgtggaggcccagctggccctgaaggaggcccgaaaggagatcaagcagctcaagcaggtcatcgacactgtcaagaacaacctgattgacaaggacaaggggctgcagaagtacttcgtggacatcaacatccagaacaagaagctggagacgctgctgcacagcatggaggtggcccagaatggcatggccaaggaggatggcactggggagtcagccggtgggtcccctgcccgctccctcacccgcagctccacctacaccaagctgagtgacccggctgtctgtggtgaccgccagccgggtgatccctccagcggctctgctgaggatggggcagacagtggctttgcagcagccgatgacacactgagccggacggacgcgctggaagccagcagcctgctgtcgtcgggggtggactgtggcaccgaggagacctcgctgcacagctccttcggcctgggcccccgcttccctgccagcaacacctatgagaagctgctgtgtggcatggaggctggtgtgcaggccagctgcatgcaggagcgtgccatccagacagacttcgtgcagtaccagcctgaccttgacaccatcctggagaaagtgacccaggcccaggtctgtgggacagaccctgagtcaggggacaggtgcccagagctggatgcccacccttcagggcccagagaccccaactcagcagtggtggtgacagtgggtgatgagctagaggccccagagcccatcacccgtggacccaccccacagcggcctggtgccaaccccaaccctggccagtcggtgagcgtggtgtgccccatggaagaggaggaggaggctgccgtggctgagaaggagcccaagagctactggagccgccactacatcgtggatctgctggctgtggtggtgccggccgtgcccacggtggcctggctttgccgctcccagcggcgccagggccagcccatctacaacatcagctccctgctgcggggctgctgcactgtggccttgcactccatccgcaggatcagctgccgctcgctgagccagccgagtcccagcccagcgggcggcggctcccagctctgagggggcccattccggcagcggcgcctgcggcctgaccactgattgtagggatgccgttcccccctcccttctcccatgggcatcatcttatttatttagttttgggtgtggaactgtttctttttttcaagatgttaaaacagtcccgtggaaggagcaggggttggagaaaggcatcccaaagcttcgatggagagcagggaagggggacccaaggcaggaggtacaccagctggacaaattgcagggaggggagggagcgagggccaacccggcccctctgtccccttggctcttcagacagggccagccctgctcaggaagtctctggctgtcttcatgtggggaagccgggcttgagttgcccataggcccctgccctgcaccatcctgtccagtgccctgcgcactccatgccgtctcttccaagccaccttgcccgcagcccaggctcctgggccagtgctctctcctcaaatggaggcagccatggcctgaagtgcagatcactgacccagggctcagagcagaggccagaaccactgggccggccggcattccagcctccccagactgctgcccaccttgggactcaggagctcagtcaaggccacaggctggaggagagacggggctgggcgcaaggtggcggagggcagtgtgggttctgtgtctgtctgttcatcccaggctttcccgtcatccctttcctcttggcacttctgggtgtgtcagtcattattcctgtgaggtagctaagcccggcaagctcagtgctggggtaggagggcctgcctgagtcccagctcccagctggagaatccaccagcacaagaagaggaggcaggggcagaaacccaagggggctcccccagccttccaaggtgaggccatctcatctgcaggctgggaggcagggctggactcaggaacccacagcttactgaaaaagccagaggccatgactgcccccagaaacttgccccgagtttctctggggccctcgggcccaacttctgctttgcactatgttcactttggggttggttctcagccatccaagggtctccagtgaggtggctgcttgctgtctgagatgagggttcctaaaccttaaacctctctgcctctggaggagggtggggtattctggcaggatgaatcgcaggatggcgcgtactgaagccacgatgttcatccaggccaaagcagggtgtcctgggataggtttcctaggcaggggcgtggcagagcaggtaggcgccctgcaccctccctgctcccagcccaaggccagtcggcctgggaagttcactgccccaactcttttcccgggaccatactgagtcccccagccacgctgctgacattaccattattattttaccaagtaaactcactccttttcccccacaggggttacacccatctggttgtcccacccactcttcagaggctaggccccacctctgggggttggagggaccctgtgtcttactcgcccctctggcctaagggccactctggttatctgccaaggttgcttgccctcaccccaatgctccaacagccattgcctaactcatgggctctgcccttctgctcggtgccctccacgtgaggcggggcacctgcatgcactgggagggggcggctggcccagccctcggggcaggagccccctctgccacacgctttgtgcctccaaagctccccccgccttggtcagggcctcagaccagccaacctttgtggaataagccccagcccagccaaaccaaacccagatgcctgaggcctggctggggctgcccccgcaggacactgtggccatgccacggagggggcagtggacaaaaccaatccaaagccaagccgggactggctgcggacccagcctcctgtgccgcgcactcacggagctgcgtagtctcctcagacatagtcaaagctttgccgagaaaagaaatgtatgaactatatttgacaacataaaatctctctatttttcaccactggaatttagtcaagcttcaggcccctctgctcctgtctgtgtcttgcgtctgtggccttcctattgtgtcttgtgttttggtggatgtgacagggctggggccacagtctactctgtctctgctgctagagaagccacctgtggaggactgggctgtggttgggcctgaggcctgtggaggaggtgagtgtagccagcagcggccgtctactcctgttctggcctgagaccaccggtgtgggtcacgaggaccctggcccacagtgttgagggtcctctctttcgggggctctcctggggccttcgatgggcttttcttcttgtcagtggagggagcagctccccactcagccctgggacaggccctgggactgtggtggccggtggccctggcccagctctggagtgcatgtgtgtgtgctcagatcccgcatctatgcaaaggtgcaggctgcctgtgaggctccaggcggtggaggtgcggcagctgctgctcaggtgccatgccctgaagaggcagggtacacatggggctgggagggcaaagatggggcggggcctccccctgagagagctcaccctccacagtgacccttttccttcctgcctaatacctcctcccgttgggctgtgacttttcctcctgccctcagcctctgaaacagaaatctttggggcctcccctttccccagcgtctggcaagagctgatgaggtcctgaggaacagtgtccccaggaaccaccttctggagcctagcggccagacgtggcttctcctgagttctagggctcgggccagagtggcactactgcccggccagtccaggctcaggcaggaatcggacgctggggcccgggctctgcacagagagctgggcttgagtggagtttattgtagatttctcccaaggggatcacttagcttctcactgacacacccttcccaattgccacaagcgcaggggtatcttacagcactttggggaggggtgggacaaactgcaaggttctggggccaaggcctacccaggggcctctgcccagagaactcacaaccccctctctgacctaggggacaatgcaaacaggtcacagtgcattcccatattaggccatccccttcacgaagaattcaggggatgtgggaagtggggaggcggggagggatcttgactcttgtctcctttgtccttttgttcagacagagttgtacctgcagcagacaactctgaattaaagcatgaaaacacagc

SEQ ID NO: 1524 - DNA, 5426 bp, Homo sapiens
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcaggctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttactggacagcgatttctggcttataagagttctctttgatttgcactagcactacgatagtgttagatggggaaatactgcaacatgtccagttggccagatcactttccaagggagcgatactaaggcagactcagctttttaaagatgggaggtcaggaggtggaagtgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagag

SEQ ID NO: 1525 - DNA, 5022 bp, Homo sapiens
cggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatgatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagaggggccctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgct

SEQ ID NO: 1526 - DNA, 7239 bp, Homo sapiens
cggacgcgtgggctgctgcggagccggcagcgcaggcgggcggagcggagctgcccccgtggtggcgggcgatgcccccgtgagcctccctcgccgcccctccccgccccgcgtgcctatccactcggagtccgcgccagcctggggccgggccgcgcctactgccgggttcgcggggcggggtcccggggcagcacctgccccgccttgcggagccgcctcggcctgtggaggccccctccctgtctggaccccggccccacctccggacccttttatcacatcgcctcctctgggagcctgccctgattgccttcacctcatttcttgaaaattggtgttttggcagaagtcaattgaagccttgtgcaaatgccctaggggtgtgctgttgggaggcagccccctgtgatgcggaacaccaggctcagattcatcagttcgagctgcctgaggccctgccaccccggggaccatgtttaacggggagccaggtcctgcctcatctggggcctccaggaatgtggtgcggagctccagcattggcggtgaaatctgcggatcccagcaagccgggggcggggctgggaccaccaccgccaagaagcggcggagcagcctgggtgccaagatggtggccatcgtgggcctgactcagtggagcaagagcacactccagcttccgcagcctgaaggggccaccaagaagctgcgcagcaacatccgccggagcacggagacaggcatcgcggtggagatgcggagccgggtcacacgccagggcagccgggagtccaccgatgggagcaccaacagcaacagctccgacggcacgttcatcttccccactacccggctaggggctgaaagccagttcagcgatttcctggatgggctgggaccagctcagattgtggggcgacagacactggcaacaccacccatgggagatgtgcacattgccatcatggaccggagtggccagctggaggtggaagtgattgaagctcggggcctgacccccaaaccaggctccaaatccctcccagccacctatatcaaggtttacctgctggagaatggggcctgcttggccaagaagaagacaaagatgaccaagaagacctgtgatcccctgtaccagcaggctctgctctttgacgagggaccccagggcaaggtgctgcaggtgatcgtctggggagactatggccgcatggaccacaagtgcttcatgggcatggcccagatcatgctggacgagctggacctcagcgccgcggtcaccggctggtacaaactcttccccacctcctcagtggcagactccacactcggatccctcaccaggcgcctgtcccagtcttccctggagagtgccaccagcccctcatgctcttaaggatgtcaggaagaggccaggatggtggtgtggggaggggtgcctgctggccccatgtcctcccctgtacatagtcttcgtgtctttctggaccccttgtcctgctgcatgcctgttggctactgggctcatcccagctggcagtggagactgtagtgtgtgcgtgtgtgcgtgcgtgtgtgtgtgtgtgtacgtgaccacgttctatctgttcatttgtctgggtatagtcactcctggtgatgatatgggctgaaatgtctccacgtctctttgtgtcttgttgaaaagaaacccaaaggagtgttgtgtggacatgactcaccctgaggagtctccagggatggaggtggggcatgcggccactggtcggtgctgcctggtcctggcctggggcagagcctgtgtgttcttcacctgtgcctgctcctggtggtctctgctttgttttctgtcttgtcttttgttccactcttgactctcccggctctgccactgttttctgagaaatgtagcatccgctgcagctggccacactgagggccctctgggaaccccaccccactggagccgctccggcagctcttcctgccactgaatgcgttctgcagcatgtagcatgcccacctagctccctggccagggccctggggaggcagagggtacccaggggactgagggcttagaaatgactttctctatgaggctggaacctcctccttcttccagtgaagcacgaggtcttggttccagggttcctggccaggtgcccccttagcatttgttcttcatctcctgtctcttcaagcctccccactccaccgtgccgaaggagctctgccagtgggcctgggcaggcagccacagagggcatgttatctgctaaagcaaacagtcctcctgaggccctgagggtggccctgaccccctcagggctcattcctggtgggcatgactcggtaaggaggttctgtgggtagggctgtttgctggaataaggagggctgaggctgagttgttccccgccactgttgaggatcccatctgacatttggggattcactgcatgaagttgttcatttggggctccagtttttgtgcatttccagaccagggtccctgtctgggagctcagacttagctgggctccagcagcctggctccggactctcgtctgccaccatcaccagctctgtctaagcaatacttacccctccgggcttccctgctttcctgtgccccactgctgccctctgcagagccatctgctccaggcacccacctgcctctgcttgctttctcacccatgtctggttggagcttctcacagccactcaaaccctgacttgatttgacaactgggccctgttggtggagaccagtgcctgaactggaccctgtgaaatctgtcccgtgggaatcctgaagtctgactcaggaatgcccagacctgtccctgtccctcctcagctctagggtgaaaggcgagaggttgcacaggacatggacagagcagcccttgggtttgtatctggtaggggagaaagcagcaggacagtggaggtgtgtggaaggcactctttccacctctctccaggcattatccccaggtgctgaaatggctgtggccccagcacctgaggcaggggtacgctacctggggtagcagtagaaaggtcttggggtctgaatgacttggggcctccattcataaccaaagttgtaggggcatggaggcagtggcgccttatggataggtcatctcagcccaaagggcctccttggctggcatggttctgtgttacgttgaagccagagtcttataacacctcccaagaaagataggggaagaagccagaaccccacctggcctgcccacaggacaagaagtgggtaagggcaggaaggaaatgaacggagttagctcccaggctcctatctctgcctgagcctctattcttatattatcagagaaagggaccattgggtgcatagagatggggaggaggccactgggctgaattttctctttaggcggaaatgctctccccaggcccattgcgttcgtcaagttcttggaaatggacaaagggctctgtcctcctcgaccctagtgggggatcaagaaggaaactccgttgcaaaagggtattttaatctcctgtttatgatatattcacctctagagcagtcactgtcagggtgttgcgaaaatactctacacctttgggatgatagggttgttagtgacccacaggacagtatagatgtttgtggatgtagcactgagtggtgatacccagaccagcagtcaccccaggaagtgggggctacccataccctcattcctctggtggggagctgcctgcagagaggcctgccactgggggttccaggccgtggtgacccttgcctctggggaagggttagcacaggggaggttctagctggaggaggggtctgatgtgctggtaacttgggctgacctacctacagtccctggctgccaaaactgctcagcagttgggccactccactattccacctctctaaaagaaggtaatttcctccccaaattgaccttggggaattattcttttaaccctttgcaccaaataagttactcatccccacctggattttaccccatgagggtaaagttgtgtgaggctgacacgtctgtgtgatgcagtgtggctgcacttaagggtctgtttctcagcatcatggatgcaggggcttgtctgaaaagccactctggacctagcctgtcccagaagaggagaatgcacaagtgtaactcctggttgtttgctggggtgggggagcatctgctgtttgaggacggggggtggggaaggaaggaacatgatccctccagaagtctcccaccctggggccaactcactgccatgttcagtgtcccggctccaaatgcccccttgcccagatgaaaccctgcagtggttacaggaatggagctctttgtcattccacctcctctggtcaggcgaggttcactgtgcatatggcagagacaggagtggccctgcagtgatgttgggttgtgggcagggacagtgatggatgactcagagcgtctgtctttgtatttctgctctgttcattctgtcccactttcttcatagactccttttccctgcaatgggtttttggtatgaaaaaggctccagtaaatggagccaagtcttggtttgacaaggggaacttgatccttcagggaagaatcatctccaaaatgactccccatctggtttcttctaccacccaattctactaggaaaggagcacttaggaggctcttgggatgcagcaagtcccaggcaatgccagcatttcatgggggctgaggcagaacccaggagctccaagaaaggccacccatagagctcatcctctgtggaatcactgccggttagaacactgaggtcaagccagtcctcccatggtcatgccacccaccagggaagcatgcctgatctcttctttactgccagccttgaggagagcagaagcctccatttttaaagacaataaagacctccaagggtacttctttggaaatgaaatgtagcacaatcttagcctacgttaccaggagccctgacatgcaaccagggtccctcttccatgccctgctgcccaggagttgctgagctcctcttcccctggggttccagccctcctaatacctcatattccccatcttcctcagcccagaaagcaatggggctttagtgatgctcctcttttgtgtctctctggttgcctctagcactgtgcaaactctgcaagaaattgctgcctttgcttgatgttgtagatgagttgccctccacctggctggagagatggcacatcattcagggccagaaggttgtccagcagtgtttctgcagtggctgcagggagatggaaaagaagagccctgcttccctgcctcctcctacctttctcttccactcctcagagttttcttctccagtatcctgacatgtaaagagattctttaaaatgctgcttcttctactggactgtctttcactgagtagtcagggaggagatgaaaatgtggacacatccccccgccttctccctcaaccttttcactcacgtcagaagaggttggggcaaaacaaaacaagcatgattgaagagcaggggaagcccacacaatcaggtgagccctgatgggggctggactggcctggtctggctgggaaaggattcttttaaaagcgtgcctgagcatctcagagcaatgtcagtgatgccaaagagagcaacttggcctccttgggcaccaactctgatggctgagttgcacaaacgtggctcagatgttggcatgcccgatggtgggaccttgttctctgataaagggcttaatctttccatgtagcaaagcaactttccctccctcccctccccccgaaccctgagcttgggcttgtgtgggcccagcatggctgtgcctgtgagggaagccacatcagtgagagaaagttgcattctctcaggggcctagattggcttggggcaggtgcttgttgaaaagcatgagtgtttctgctttgggaaacccttccagggctctggttggaaacttggccagtaaggacagggccttgggcctcccaaggagttcacaatgatgccaggaagggtccctgagcctgggttccagtcagcttggctaacagaatggggcttgggaattccaggggcaactgagcatccaccccattagccagtgatctggacagggacagctggctacagggaatcaaaggctgttctgtacagttttaccagaaactgtgaccttgggtaaggctcctcacttttctgggcctcaacttcctcatctgcaaaatcagagcattagctgctctccccatgattccctcccagttttaattaaaagtctctgatctggagcacatgagggttgcgagcctggtgcacctggttcctgtctccgtgggctggtttccttcagcccctgatgcccaggctgggtgcaggctctcatctggtccatgcccagatgctgcctcagacaagaactctgggaatcctaacagactctgctttcctctcttcgtggtttgtcctccctcttttattcttgtgtaatgatgagacataattaagggtcatctacaatggacaattttcaaggtgctgatgtgatgtcacaacctccgctacatcctgagtaagtcagtgtccccaacagcagatgaggctgggtctttcctcatttctgcttctgggatgacatcagtgggagagttgaagatctgagaattctaaaggaaatgttctctgatgggaggagagagggaacttatttcccttcaaagtagtttgcttcttaagaccactcctccctccagaatgtctttaaccagacatcatttcagaaggtggggcagctgcttccttaggaagagtgggcctgatagctcaaccaactcctttagcatgtaaactcacagaaggcaagaacccctttttttagactttccaaatgcatcctgcaaagagagagatagctgatagggactgacaagcacactgtttagataagaagcaattacccttttatatctgtgctctatacattttctatgtgcagcatctttcctaacttgttgtggttcccgggtggcaggtgcacagctgggagggactgccggctgtttcgtacaacattcttgccaattcccttgaggagaaaattcttcacatggcttctgcatgtacagtatttgggcagcaaaacatgattaaagtcagtttgaaaatgg

SEQ ID NO: 1527 - DNA, 2640 bp, Homo sapiens
aaatagacactttggtttgaaagatgtaaacattccaaccttggaaggtagaattcttgttgaattagatgagacatctcaagagcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattccttcgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaaccatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcaccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttg

SEQ ID NO: 1528 - DNA, 2504 bp, Homo sapiens
ctttgccgtccggctattagcctactgtggctagtcacccccggggtcccggccttctcgggctggggccgccgccaccgcggcaggacggggaggcgggccatggcgtcctgcgtggggagccggaccctaagcaaggatgatgtgaactacaaaatgcatttccggatgatcaacgagcagcaagtggaggacatcaccattgacttcttctaccggccgcataccatcaccctgctcagcttcaccatcgtcagcctcatgtacttcgcctttaccagggatgactctgttccagaagacaacatctggagaggcatcctctctgttattttcttctttcttatcatcagtgtgttagctttccccaatggtccgttcactcgacctcatccagccttatggcgaatggtttttggactcagtgtgctctacttcctgttcctggtattcctactcttcctgaatttcgagcaggttaaatctctaatgtattggctagatccaaatcttcgatacgccacaagggaagcagatgtcatggagtatgctgtgaactgccatgtgatcacctgggagaggattatcagccactttgatatttttgcatttggacatttctggggctgggccatgaaggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttggggtcattggtttcctggaggccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaagtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagcttggtgccttttacatcgggtttgttctccttccatggtgtgttgctgacattgtcactgagtcccatgtgaggtgctggtgagtattacctttcatctgtgccatgctctagaaccttgaccttgatagttcaccacgtctgatggatccctgttttaaataaaaacgattcactttaaagcct

SEQ ID NO: 1529 - DNA, 5316 bp, Homo sapiens
cggacgcgtgggaacgaagccacccattacggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagaccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgaagtggaggatgactatatcaagagctgggaggacaatcagcaaggagatgaagccctggataccaccaaggacccctgccagaaggtgaagtgcagccgccacaaggtgtgcattgcccagggctaccagcgggccatgtgcatcagtcgcaagaagctggagcacaggatcaagcagccgaccgtgaaactccatggaaacaaagactccatctgcaagccctgccacatggcccagcttgcctctgtctgcggctcagatggccacacttacagctctgtgtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcagaagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtaacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcctgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcaacaggaggaggctgtggctgcagagcctggaggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatcccgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccatatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccccactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccctgcctccacttggggaccctgcctcgtgtcgtctttatctgcctattactcagcctaaggaaacaagtacactccacacatgcataaaggaaatcaaatgttatttttaagaaaatggaaaataaaaactttataaacacc

SEQ ID NO: 1530 - DNA, 3950 bp, Homo sapiens
aaggggccttctgaggtttgggggctgtagggccatgggcctcagggccagaggtggttgttagcctggcaagacaggtctgggcaacatgcatgcccagaggcagttcgttgtagctgcagtgagagcagaagtcagacgacatgaggtggccaagcaggctctaaaccgcctcaggaagctggcagagagggtggacgaccccgaactccaggacagcatccaggcctcattggacagcattcgagaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagaggaaaactttgagttcctgatcgtgtccagcacgggtcagacgtggcactttgaggcagccagttttgaggagcgggatgcctgggtccaggccatcgagagtcagatcctagccagtctgcaatgctgtgagagcagcaaggtcaagctgcgcacagacagccaaagcgaggccgtggccatccaggcgatccggaacgccaaggggaattcaatctgcgtggactgcggggcccccaaccccacgtgggccagcttgaacctgggcgccctcatctgcatcgagtgttctggcatccaccgcaacctgggcacacacctgtcccgcgttcgctcgctggacttggacgactggccacgggagctgaccctggtgctgacggctattggcaacgacacggccaaccgcgtgtgggaaagcgacacgcgaggccgtgccaagccctcgcgggactcttcgcgggaggagcgcgagtcgtggattcgcgccaagtacgagcagctactgttcctggcgccgctgagcacctcggaggagccgctgggccgccagctgtgggccgccgtgcaggcccaggacgtggctaccgttctcctgcttttggcccatgcgcgacacgggccgctcgacaccagcgtagaggacccacagctgcgctccccactccacctggcggccgagctcgcccacgtcgtcatcacgcaactgctgctgtggtacggcgcggacgtggcggcccgtgacgcccagggccgcacggcgctgttctacgcccgccaggctggaagccagctgtgcgccgacatccttctccagcacggctgcccgggtgagggcggcagcgcggccaccacgcccagcgcggccaccacgcccagcatcaccgccacgcccagcccccgccgccggagcagcgccgctagcgtgggccgcgccgacgccccggttgcgctggtatagttgcccagcgggagagacacccccatccccacgcgggccgggcacgaccacaccgggcggaccgctggacagacgcacccactcacctctccgatccgcaccccgccccacgggagcacttcctacccccacgagggcacagcccccacgccttccagaagacacaaactcacctccctctccccaacgaggcatggagaccccagctcaacacgccccctctccattgtttccacactcggattgctctgggtctacccgctcggggttcgcggaaggggaggtccccagcggtacgggctcctaggcgcttggacatgcccgcttgtgccccctaggggcggaaagaagacccggtcctgcccgagctcaacaatcccagggcgggagcccatacccaggctggctcctggggcgacgccacgccagagggagggtttagtacatgggagggctagccccgggacttggggccaatacggaaaccctaccccttccatgctcatctcactgcccagtgaagggggcaagggcagcgaggggcaggacccctgctgctcatgggggtgggggttcccaaccctttccgtgaaagggaccgtgagtagtggaaaccaggacgtcccctacacctacccatgggtggaagctaaagagtccggggggaaccaagagcctgggtccctcccactactatcttgggagggagaagggatggagcaggagcgggctaagagggctgcgggggccttgtaatttattgctttgttccccaacatggggatgggggcgggcaggggcgtggggagggcgttttggggtaggggaagcccagggtgggcagggggtgggttggggtgggggtgctctcgggttgtgtctgtgaccgtgactgcgtacctgtgactgtgcagcgcccgtggtgatctggggtagggggcacccctacagtgggacccctcccccattattctttctgtccagcccctccctcccactggagcagctccagagccattcctcacccccgtgacctctcccagccagggctgagaggattcgaggtggctgggagggtttccaggccccctgccccttccccacaaactgggtgatagggcggacttacctggcccagccctgcctccctcagccaacccagcccttgggctgtctgtgtcagtggtttccggtctttttttttttttttttttctggctaaaatagtttgcaaaggaccaggtaattggggaggggagagaggtgggggcaagggggaaatgcccccccatctccttggaggcagtggtgtgaatcttcttcaacagcaattaaagaggaagtgattttg

SEQ ID NO: 1531 - DNA, 3020 bp, Homo sapiens
cgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgcctaacctcgacaggtcaggtccccatggcccaggcacgagcgggggtccaaggtcccatggatggaaggatgccttccaatggatgtcttcccgtgtctccccgaacaccctatgggatgccatatcttggggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtcccggtgattttggcttcctgcatgccagtagtagcatcgagtccgaggcaaaaccagcccagcctcagcccactggtgaaaaggaacaagataaatcaaaaactctttcccttgaggaggctgtgacttccattcagcagctcttccagctcagtgtttccatcgctttcaacttcctgggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggcccaagctttcctcggggtgcttttcaccaaggagccctacctggatgagcagagagctgtgaaatatctttggcttgcagccaacaatggggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctc

SEQ ID NO: 1532 - DNA, 2287 bp, Homo sapiens
cgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagttgcttggaaaagatgctaattaatgaagaggagcaactactattggtgtatttttcacagattggtgctttctaaataaaaattgaaagtaactcctaacattgaatgggtttgctactgaaaaagtaatgatcttctggtgcaaacagttgcttgtggacttaaaccttggcactggtggggaatttggtcagattttacaatctctgtcaaagagtagacagctgaactcacaccacacccagcttatagaatgtccatggaagatgaaggcgcaccagaagggaaggaccctgcgcagaatggacgtggtgaatggtgtttaaaatgccagatgccaaagagtaacacgattccctgctgaccccttaactctaatccatccagcaccatggagcagcctgcatgtgaggaatggaaggagcattcagggcctccaagtgacagtctctaaaatggggtggtgccaggcagattagcatgttcaaagctgacaccactgaggtcgtgttttttgggtgacaaagccaaaggagagaaaggccaaatattccagccctggccgaaagatgatcactcaccagacggaagcaagcgtgctgcgtggagcatccatgcgaagatgtcaattccatagatcaataggtttccagttttcttcgtgatatgttaatatagcaaacttaccatgatccggttttctcttttttctctttttttttacaaagtgctgaattgtttggaatatcaagagtattatgtaataaaaacttgttgatcat

SEQ ID NO: 1533 - DNA, 2620 bp, Homo sapiens
caactctattgcgcagctcgctgccgtgcgtttaacccaggcgaggaggaggaggagaaaattcccccagattcgggcaggcccgcaccccacattccgtcctgttttgagaggaggagggaagagaaataaacgtggcagcgcatagaaggccagcagggagactgctttccagacacctccggcccacacagccgttcaccccccgtcttttcagtcctggaaaaggaattcggtctgtccttaggatgaagctctaactgaactgaagtaaggagaaacagccttgaatctttggagggtctgtcttccttttgggctctgtgcaactgcagctacagtggaaaaaagcaaactgctcttgatcccaggccctgcctaagcctcagcagaacttgtaagcctaaactgaagagtctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccaacacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactg

SEQ ID NO: 1534 - DNA, 6313 bp, Homo sapiens
gccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacctggggaaccaaggataggggaaggagtcagcacagtgaaaggctgcctttatccctgcccacatgttccctctctcacagttttccccccacagagcccctttcagtggccccttggtcctcctaactaagctgtcacctaccatatgtgggcctttttgttttataacaggagtattttctctccaggtccaccccaacctcccctgatttatagcctgaagccttatctttcacactagtgttggtcccttcaggtttggcccatcttgtattgctcttctgttcattcttacatcacagcaatctagtcactccctggtcatccctcagtcactcatatcagagtcattctctctggccatctttggtcactcacgtgtcacagcagcccacgccaacaggatgcagacaggtgcaatggaaacagtccttgcggagccaagactcacccagggtaaaatatttcccctcatagtgacagggggctagggaagaacgggaaatgttagtaggtgtaggagtgctgatgagaggcagaggctcttctggtctggggtggagacagtaagtacgcactatccccgtatttagtttgtctttcctgtttcacagctggaggaagcctgggtattttgacacgggatcatctgtaaggccccatcctccctgtgccctctctgctgctcctccattcctaacgcttcaccccactttaccttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcgagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaat

SEQ ID NO: 1535 - DNA, 2470 bp, Homo sapiens
ttggcgggcggaagcggccacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatat

SEQ ID NO: 1536 - DNA, 3997 bp, Homo sapiens
ggcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaatatacaagatacttgtttgccttgcaacttaagagagacctgctggaagagcgtttgacctgtgctgacaccacagcggcccttctcacgtcccatctcctgcagtcggaaataggagattacgatgaaacgctggaccgagagcacctcaaagtgaacgagtatttgcctggccagcagcactgccttgagaagatactagaattccatcagaagcacgtgggccagacacctgctgagtcggatttccaggtgctcgaaattgctcgaaagttggaaatgtacggcatcagatttcacatggcttctgacagggaaggaaccaagattcaactggcagtttcccacatgggtgtactcgtgttccagggcaccaccaaaatcaacactttcaactggtccaaggtccgtaaactaagcttcaagaggaaaagatttcttatcaaacttcatccagaggttcatggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggcctttccacgaagagtcctcagccttctccctccagccggaagagccccctgagtctgagccctgcatttcaggtgcctttgggcccagctgaacagggctcatccccactcctgagccctgtcctcagtgatgctggcggagccgggatggactgcgaggagcccagacacaagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggagtttaccagctacttccaaagacatgacgaggtcctaacagaactggaaaaggctaccaaacgctgtaagaagttggaggcagtgtacaaggagtttgagctgcagaaggtctgctacttgcctctcaacacgttcctgctgaagcccatccagcggctgctgcactaccgcctgctgctgcgccgcctatgcggacattacagccccgggcaccatgactacgctgactgccatgacgccctgaaagccatcacagaggtgaccaccacactacagcacattctcatccggctggagaacctgcagaagctaacggagctgcagcgggacctggtgggcatagagaacctcattgctcctggcagggagttcatccgtgagggctgccttcacaagctcaccaagaagggcctgcagcagaggatgttttttctgttctcagatatgttgctgtacacaagcaaaggagttgcagggaccagccacttccggatccggggcctccttcccctccaaggcatgctggtggaagaaagtgataacgagtggtctgttccacactgtttcaccatctacgcggctcagaaaacaatcgtggtggcagccagcactcggctggagaaagagaagtggatgctggacctgaactccgcgatccaagcagccaagagtggcggtgacacggcccctgcactgccaggccgcactgtgtgcactcgtccccccagatcccccaacgaggtatctctggagcaggagtcagaagatgatgctcggggtgtccgcagctccctggaggggcatggccagcaccgggccaacaccacaatgcacgtgtgctggtaccggaacaccagcgtgtccagggcagaccacagtgcagctgtcgagaaccagctttcaggatatctgctaagaaagttcaaaaacagtcatggctggcagaagctctgggtcgtctttaccaacttctgtttgttcttctacaaaactcatcaggatgactacccactggccagcctcccgctgctgggctacagcgtgagcatccccagggaggccgatggcatacacaaagactatgttttcaagctccagttcaaatcccacgtctacttcttccgggctgagagcaagtacacatttgaaaggtggatggaggtgatccagggggccagcagctcagccgggagggccccaagcatcgtgcaggatggcccccaaccctcctcagggctggaggggatggtcagggggaaggaggaatgacgctcaacctgcccaggtttggacacaactacaaagaacagcaggacacagaggtgacctctgtcctgaggcttctcaacagatgggaagtggctgtggtctcactggatccccactggcaccagcagtgtgggtgggcctcatgtaacatctgggaggggcttcatccccccacccaggacctagtgcatgccagcagctatctggggccctgggaaaaatgtgcgagtcttgagcgcggagccgctcaagccacagctcccaggcccctggctcaaagacgcagacaaggcctgagcagtgctctcggcatcggaccaaagcctgggcacaccctgcctctctccccagagcagggtccctgccgaggactggcctagagcaagcactggaaaagaggccctgccatacaccctgcgtacccactgccaggaccctctcagacaagcgtggcacagccatgctgaccttccatctggtgaaccaagtggcagccccaggggcctgccctgcaggtcacagctaaacaagtctggcagaagccacgcttgttccccatgtacctctagagaagcagaaaccaaagtccccctgtgccctgggagggtggggccgtctaatttattactgcccagcattccttccaacgggaagtagatgggcgactgctttgttcacacacatttgattaaaaataaacaaacagcatctcccc

SEQ ID NO: 1537 - DNA, 4932 bp, Homo sapiens
gcgcggcccgggcgcggggcggcggcagcggcggcgcgcggggaggcggggaggcggggggcccggccggacgcccctgcgccccctccccgcgccccggccgagggcggagcgcgctggccctgcagcctccggcccgcccccggcccgccgcctcccccgggacgtgggacgcgggcgcaggcggggtccgcgcggcgggcggcgggggacgggcggagtcaaaagtctattgaaaaagcagagagagaatgcctcggtgtgtaagtggagtgatgaggacctgatctctgggccgtgtgggaacactggctgccatttcatcacagtcaacctggactcacagaatttcaagagcttgtcggttgggtcaagaatgaacctacgcatgacggcgtgctgatcctgggtttctagtcatcctttttaagctgcaaagaagcatttgcagacgttgtctcatgggtaccgcttgccaactttggaggatgtgaagccggtagagaaataaagcatcgcccctctgcgcgcccctccccgtctgctagaatgtttctcatgaacgcttctccagtggttgctctccagtccaaatgggaggcctttggcccgccagggagctgtaggttccccaggtgcttctcggaggctgacgagggcgtggagagcgcgtcggtgagcgcccgggtgcagatgcttatcagcactctgcagcgcgacggggctgctcggggcaccagcgatgagcgcgccgcacagaggggccacagggcagagggatgccacgacgccaggccggctgccaagcccaccgtgcacaaggagccacccgcgttggctgtctgtggtctcgttgctgactttgaccccatgggggaggaggaaactacagactttggcccgttggtgctagattcagacagtgatgattccgtggacagggacattgaggaggccatccaggagtacctgaaggcaaagagtggagccgcacagcccggggccggcggggcccagccaggtgcagcccagccttccagggccgcaggcggaggcagtagatgtaagccggaaccggctcacggcagtgccccgactgccctgtgtcccccaaaacttgtacctggatcaggtggtggccccggcagccaggtgggatccagcaaggaccagggctccgcctccccggtcagtgtgagcagcgatgactccttcgagcagagcatcagggcggaaatagaacagtttctgaatgagaagagacagcatgagacccaaaaatgtgatgggtcagtggagaagaaaccagacacaaatgaaaattccgccaagtcactcttgaaatcccaccaagagccgcctacaaaggtggtgcatcggcagggcctgctgggcgtccagaaggagtttgccttccgcaaacctccccggttagcgaagatgaacgtccagcccagaagcctcaggtccaaggtcacaaccacgcaggagaacgagggcagcacgaagccggcaaccccctgccgcccttcagaagcagcacagaataaaggtgggatcaaaaggagcgccagcgctgcaaggaggggaaagcgagtcatgagtgcggcacaggcgtccgaggcgtccgactccagcagcgacgatggcattgaggaggccatccagctgtaccagctgcagaaaacacgcaaggaggccgacggggacctgccccagagggtccaactccgagaggagagagcgcctgaccctcccgcacacagcacaagcagtgccacaaaaagtgccttgcccgagacccacaggaaaacacccagcaagaagaagctagtggccaccaagaccatggaccctggtccagggggcctggacactgaccatgcccccaagctcctgaaggaaaccaaagctccacctccagcgagccctgcttccaggagtgagtttgtggaacggtcctcgtgccgggcggacacatctgctgagctgatgtgtgcagaagcaatcctggacatctccaagacgatcctgccggcccctgtagagggcagtgacgggtccctgtccgcaagcccactcttctactccccgaacgtgccttcccgctctgacggcgacagtagctccgtggacagcgatgacagcatcgagcaggaaatccggacatttttggccctaaaggcgcagtcagggagtttgctggccagaggtgagagctgcccgcaggctgcccagggtccacttttgccgcctggcctcaacagccagaccggcggccacaagacccctctctctaaaacaccagacccactgctgggctgcaaaaggaagcgtagaggtggtggccatgtgaggccatccacgcccaagaaaatgcaggaggtggtgaaagacggtagccaggatgccgaccacagccaggggagagctgagcccggccatgagaggcgagacctgcccatccagggcaaagccagtgaggccctgggaggggagggcaccgccaggggccctggcgacactcgcatgtcacagggccagggtaagacagacgaggcaaggcgcctagacgagaaagagagctctgaagacaaaagcagctccctggacagtgacgaggacctggacacagccatcaaggacttgttaaggtccaagcgaaagctcaagaagaggtgcagggagcccagggctgcgtgcaggaagaaggtcaggttcagcacagcccagacgcacttcttggagcagctgggcgggctccggagagactggaaagacaggggcccgccagtgctgaagagctgcctctccaagtccaagagagacagtggcgagggtcctgggaagaaaccccccagtgtctttggcagcacggcagagaggatgaggcaggagggtgccgcgagccaggacgcggccctggccttccgggtgaggagacccgcctccgcctctgcctccgaagggaatccattccccagggagtcccagggcccagctcccagccccggctccctgtctgatgacagcagttcagtggacagcgacgacagcatcgaactggagattaggaagtttttggcggaaaaggccaaggagtcagtgagcagttcagaagttcaggcagagggccccaccgctcttgggacagggggcccagccaggccagaggtgctgtgcaggaaggagccggccccaccgcctggcgtgtgcacacgcagccagagggccaggggggtcccacatctggccgaagggcttcgaggcacagagagcgcaggagcacagggcacagctggtctgttcagccagggcgggaaggggctccctgctgctcctgcccgaggggatccggtgccgcccaggagcaccagcggcggtgtctccgccaaggggctctcagtgagcaggagaaatgtttacgttcacaaagaccagagcccacgaggggctgagcctgctgccaaaagtgcttttggtcagctgcccagctgtgccacagcgggcaccgaggcaggaggcgccagaggaacctttcacatgggctgcgggagcccgagcttcctgacccccagcccgggagcggagagggacgctggagcccaggccgaccgcacaccgccctggagcgacttcgcccaccagagtcggctgcccagcccgtgggtgctgcgctccgaaggcagagatgcagtgtggagggggggcgtcgggagcgagagagacaaggggtccgagggccccgcccggggcctgcccagcctgccccttgcgggcttctcgccgctgctgtccacccagctcttccactttggaaagggtgtctcctgggggggcaggcaggctggcctcttcagcccccacctggggctgcctctgcagggcccctccttctcggccttcagggaggcccaggccggacccagccctgtctttggaagcccacacttgctggcaaagaaggacggcggcccctggccaaccaggaaggcacaggcagggctgagtttgcatgacaggaggagctcgggctcggaggaaagcattttagacctgaggtatcgacgaagggtcaacagggatgaccaggagcaggacgccttgggcagtgacgccagtgacttcagcgacacctccacggaggacagtggcggcagctcagtagtgaaggtctaagccctcgagctgtgggttcgcgtcctgggttgcgtgcattcgtggaaagcggcgtagccgtgcgtgtgtgtgatggttccgtggctgcaaggaagggaaacagtctattatacatagccctgtatatatgtacaccaacatgaaacttttatttaacagacgtgtcctggtaaatatgatttttgtagctttttgtaaattatttaaagtgatgtaaaagatatttttggaaaatactgttgttcaattttgtagggtgttcctaactgcagttttctgtgttctgcatacaagtcttagcttaggaaacatttggttcttaccatcacagccaggttcacagaggctctgatgctttttggttgattgctggtgagaatggccggcggtggctgcagtggtagcctgaggaaggccaagctgccctccctgggaatcactcagatgccccaagatgtccgttgggaagctcccaggacagcactttttatacagaggacaccgcctcggccccacgtccttagaggccagagcacatctgaaaactgcaatcacagccgtccgctggaaaaacgtttcgaagcacagtggccagcgagcgagcacgtggctactccctgttgcatgtcaaatccacacagatgtcagcggcagctgctcggcagcccagccctgggcctgggtgggttcatgtccaatcttgttcgatcactagatgattctaacatcgaaataaacctctttttatatggc

SEQ ID NO: 1538 - DNA, 6830 bp, Homo sapiens
ccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggggattgataatactgtatttgttttaagcccacagtgtttttactccactttcaaaaagtcaatttgggcactttttttcatttttttttaatgggaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 1539 - DNA, 4933 bp, Homo sapiens
cagaaatgcaacaagtagtacccggggtctgcagagcgccccgcgccgcctgacttggccgggcgaagcccgcctgcagagacccgggccggcctccggacaaaggacggaggaggggctggacggcgctgcgaagtccgaaagaggccatttagcgactctggccaggctaaggggaatgcagaggagacacagagccggcgggccaagaggacgatccggccgctgcacgcagggcgggaggcgatggaggctgcccgcgccttgcgcctcctgctcgtggtgtgcggctgcctcgcgctcccgccgctggccgagcccgtgtgcccggagcgctgcgactgccagcatccccagcatctcctgtgcaccaacagggggctccgcgtagtgcccaagaccagctcgctgccgagcccccacgacgtgctcacctacagcctcggcggcaacttcataaccaacatcacggccttcgacttccaccgtctggggcagctcagacggctggacctgcagtacaaccagatccgctctctgcaccccaagaccttcgagaagctctcgcggctggaagagctgtacctggggaacaacctcttgcaggcgctcgccccgggcacgctggccccgctgcgcaagctgcgcatcctctacgccaacgggaacgagatcagccgcctaagccgcggctccttcgagggcctggagagtctagtcaagctgcggctggacgggaacgccctgggggcgctgccggacgcggtcttcgctcccttgggcaacctgctctacctacatctggagtccaaccggatccgctttctgggcaagaacgccttcgcccagctaggcaagctgcgcttcctcaacctctctgccaacgagctacagccctccctgcgccacgcggccaccttcgcaccgctgcgctccctctcctccctcatcctctcggccaacagcctgcagcacctcgggccgcgcatcttccagcacctgccacgtctcggcctgctctcgctcaggggcaaccagctcacgcacctcgcgcctgaggccttttggggcttggaggccctgcgcgagctgcgcctggagggtaatcggctgagccagctgccaactgcgctgctggagcctctgcacagcctggaggcgctggacctgagcggcaatgagctgtccgccctgcacccggccaccttcggccacctgggccggctgcgcgagctcagcctgcgcaacaacgcgctcagcgccctatccggggacatcttcgccgccagcccagccctttatcggctggatctagacggcaacggctggacctgcgactgccggctgcgaggcctgaagcgctggatgggcgactggcactcgcagggccggctcctcactgtcttcgtgcagtgtcgccaccccccggccctgcgaggcaaatacctggattacctggatgaccagcagctgcaaaatggatcctgcgcggatccctcgccctcagcttccctgaccgctgaccgcaggcggcagcccctacccacggccgcaggggaggagatgacgccacctgcaggtctcgcggaggagctgccgccgcagccgcagctccagcagcaggggcgatttctagctggggtggcctgggatggggccgccagggagctggtaggcaaccgcagcgctctaaggctgagtcggcggggcccgggcctccagcagcccagcccctccgtcgctgccgccgcgggcccggctccacagtccctagacctgcacaagaagccccagcggggccgtccgactcgggcagatcccgccctcgcggagcccaccccaacggcctctcctggctctgcgccatcgcccgccggcgacccctggcagcgcgcgacgaagcatcgtctgggcacggagcaccaggagcgtgccgcccagtccgacggtggggccgggctgccgccgctggtgtccgacccatgcgacttcaacaagttcattctgtgcaacctgacggtggaggcggtgggcgcagacagcgcctcggtgcgctgggccgtgcgcgagcaccgcagtccccggccgctgggcggcgcgcgcttccgcctgctctttgaccgctttggccagcagcccaagttccaccgcttcgtctacctgcctgagagcagcgactcggccacgctgcgcgagctgcgcggggacaccccctacctggtgtgcgtggagggcgtgcttgggggccgtgtctgccctgtggctccccgggaccactgcgcggggctggtcaccctaccggaggccgggagccggggcggcgtcgactaccagctgctgaccttggccctgctgacggtcaacgcgctgctggtgctcctggccttggcggcctgggcgtctcgctggctgcgtaggaaactgcgggctaggcggaagggcggggccccggtccacgttcggcacatgtactccacccgacggcccctgcgctccatgggcaccggcgtgtccgccgacttctcgggattccagtcgcaccggccacgcaccaccgtgtgcgcgctcagtgaggcggacctcatcgaattcccctgcgaccgcttcatggacagtgcgggcggcggcgcgggcggcagcctgagacgggaggaccgtctcctgcagcgatttgccgactaggtccagggcatatagagaccatctcattggccctaaggagccgcctctccgtgaggcccaccagcccacctcaggggaagtgccgttttgtgcacttgccagagaggccggtggggacagagggccaattcgggcaccatcccccaattcccaatactcgagaagtaaatggatggtacttggtggtcagagccagagtaggggacaaatggatggtgggatgctgaggtcggaggcttcgcttggaggctttgacacagctatgcgaatggcttttgtagcactgcaatgcagaagccaggctttgggggtagaaagggggtgcttgtgcccccaacatggccagaaatatttgggtgcatgctttttgtttgctcagtgtcaaacagagaagttttgtttctatttaaggaaggaacttattaccattacaaaggaggcttggccagggactccactggtttggtgatctctgccaagaagggggatgtaaacaggtggtaaagtttaacatacccgccaaggaactcgtttatgttggctgatagagcattcaggataccttaaagtttaataagagacgcatttttttttttcaaaaatgtgaaaagctctgacatttaacgaactgaccaatagactcaaggactgttttagttggactgggccattttattatgttccttttaatattaacagtacaagagcgcttgctgacttcgaggataactaagattacatactttctcaggagaaggctgcatgcaagacttctctgtcagggttgctcctgtggcttttttaattttatttttttaaacctatatatggaaaaggaaatttcaatgccagatttgataaaagaatgtgatgtatatgtagctgatgacccactggggaacaccagtgttccagttcacttaccacatctgtgacagtgtgtttagattggaataaatgtgatgcattacttcttatgtttttatcagtgacatggttgactgtgccctaattctcttgagttgcagttaagcaatgaaggttatttcctaatagggaagcaaaaggtgattgtcaattgatagtttaatgtttgaccacattagtgtctttatatgaaatagtagaggggaagaaattatagaaaacaaatgtgaaaaaaatacaccagtgggtatctgttctactaaaaccagaagattgttatgagtacttaaacctcactgtgaaataatgatatattttgcaattaatccctccccaactgagtgtcttactgtgttattaaatcttatcttttagttaatagttgcagtatttcttttaaatgtttttgttttaaacttaggggtaggatcctttatttgttcagttgtttccaactatttgggatactttcattccctgctatttatgaagtacatgtttatcactaagtgtagtggtttggtttacattaataattttatgtgtggtctaaaaatgcagtcactaagagaatgtacactgtggttatggtcacagtggttatggatttattggcagtggagtaccatggaggtcactgcaatggtgctaaggctgacagtggaatcttctgtttagggccttaagcccctgagggtcctggtgactcagggaatccatcacagccccgggtctttcaccccagttcactccttttatgtttggcctagattgacccatgcctgccctcttctcaacagctgagtagggaaccagccatctgaatgagctgatcgttgtttatgttcaaatgagtaaatgtccagaccacttaaaactacagctgcttttctggcagtctcgtctgcggggccaaaacttaataaaccacaggaaatagactgtcattcttagtttgctgccagggcttattttagattgagagcatactggtacatgagagcagtagtgttgtttgctcttattttcaaccagggagctatctggcaccttttgtgctcctggcttttttcaatcatagcactattgcatctcctagctatttcttttgcccagcagggtaatattgagtcccattgcaagtatggacaaggcctctggttctcctcaccacccaccttttcagccatagaacatcactgaaaatgcctaatgcctggatctgtgttctactttagtttcactgggaagtctttcagtgggagatgaataaatgttatacattgttatgtccagttatgtcaataaacccactaatagagat

SEQ ID NO: 1540 - DNA, 5217 bp, Homo sapiens
gccgcgggaggggcgcgggggcagacaaagccgcggtaatgaatggagcgtccgcccgcgccgccgtcgtccgcagccggccgggagccgccccagaggccgggccgaggtaatgcacaagggtcacgtgtatgctctcaagatgatcaggcagatcctgtcctcaggaccagaagcacgtctctgctgcacacattgttgtctacaccatgagtgtttagtagcaggactcttggaaagcagtgatctatgctgtaagaccatgagtcacagattctttttttcagtactatttatgattagccatatttctagaaacatcctgaaagatggaattatgacgaaaaagtgaagataatctacattcgggggcacaaatgagcacttggatcagtgttttatgaacctaagatacagccggagtagttatggtcagtcatggagaataacttgaaaacttgtcccaaagaggacggtgatttcgtttctgataaaataaagtttaaaatagaagaggaagatgatgatggaattcctcctgatagtttggaaagaatggactttaaaagcgagcaggaggacatgaagcagacagacagcggtggggagcgagcgggcctcggtgggacgggttgcagctgcaagcccccggggaagtacttgtctgcagagagtgaggatgactatggcgcgctgttctcccagtacagcagcaccctatacgacgtggccatggaggccgtgacccaaagcctcctttccagccggaacatgagctccaggaagaagtctccagcctggaagcatttttttatctctccccgagacagcactaaagcaatatgcatgtactgtgtgaaggagttcagcagaggcaaaaacgagaaagacttgagtaccagttgtctcatgaggcacgtgaggcgcgcacacccgaccgtgctcattcaggaaaatggcagcgtgtctgccgtgtcctcgttcccctctccctcactcctgcttccaccgcagcctgcggacgcgggtgacctcagcaccatcctctcacccatcaaacttgtccagaaagtggcgtctaagatcccgtcccccgatcgaataacagaggagtctgtgtctgtagtttcttctgaagaaatctcctctgacatgtccgtttcggagaagtgcggcagagaagaagccctggtggggtcgtctccccacctccctgctctccattacgatgaacctgcagagaacttagcggagaagagccttccacttccaaagagcacctctgggtccaggagaaggtccgctgtctggaagcacttctacctgtcgccactggacaactccaaagctgtctgcattcactgcatgaacgagttcagccgggggaagaatgggaaggacctgggcacgagctgcctcatcaggcacatgtggagggcacaccgcgccatcgtgttgcaggagaacgggggcacgggcatcccgccactgtactccacccctcccactctgctgccttccttgctgccgccggagggggagctcagctctgtgtcctcgtctccggtaaagccggtcagagagtccccttcggcctcctcctcccctgacaggctgactgaggacttgcagtctcacttgaaccctggagatgggctgatggaagacgtggcggccttctcatcttccgatgacgtaggggaggcctcggcgtcctctcctgagaagcagcaggctgatgggctgagtcctagattgtttgaatctggtgccatcttccagcagaataaaaaggtcatgaaaagactgaagtcggaggtctggcatcacttctccctggcccccatggacagcctcaaggccgagtgtcggtactgcggctgtgccatcagccgggggaagaagggtgatgtgggcaccagctgcctgatgagacatctctaccggcgccatccagaagttgtcgggagccagaagggcttcctgggtgcaagtctggcaaactctccgtatgccactttggcctctgcagaaagttcctcttccaaattgactgacttgccaacagtggtcacaaaaaacaatcaagttatgtttcctgttaatagcaaaaagacctcgaagctgtggaatcatttttctatttgctccgcagactccacaaaagtcgtgtgcttgcactgtggccggaccatcagccgggggaagaagccgactaacttgggtaccagctgtcttctgagacatttacagcggttccatagcaacgtgctgaaaactgaggtctcggagacggctcggccctcctctccggacacccgggtgccgcggggcacagaattatcaggcgcttcctcttttgatgacaccaatgagaagttttacgattctcacccagttgccaaaaaaatcacaagtctcatagctgaaatgattgcacttgacctccagccatattcttttgtagacaacgttggctttaacaggctgcttgaatacttgaaacctcagtactccctccccgccccttcctacttctccaggacagctatcccaggtatgtatgataatgtgaagcagataattatgtcccaccttaaggaagctgagagtggtgtgatccacttcacgtctggaatatggatgagtaaccagacccgtgagtacctgaccctcacggcccactgggtttccttcgagtcgccagcccggccgcgctgtgacgaccaccactgctcggcgctgttggacgtgtcgcaggtggactgcgactacagtggcaacagcattcagaagcagctggagtgctggtgggaagcgtgggtgacctccaccggccttcaggtgggcatcaccgtcaccgacaacgccagcatcgggaagacgctgaacgagggggagcactcgagcgtgcagtgcttcagccatacggtgaacctgatcgtcagcgaggccattaagagccagcggatggtgcagaacctgctgagcctcgcccggaagatctgcgagcgggtgcaccggtcgcccaaggcgaaggagaaactggccgagctgcagagggagtacgcgctgcctcagcatcacctcatccaggacgtcccgtccaagtggagcacttccttccacatgctcgagcggctcattgagcagaaaagggccattaacgagatgtccgtcgagtgtaacttccgagagctgatcagctgcgaccagtgggaggtcatgcagtccgtgtgccgtgcgctaaagcccttcgaggccgcgagccgggagatgagcacgcagatgtccaccctcagccaggtcatccccatggtacacatcctcaacaggaaggtggagatgctcttcgaggagacgatgggcatcgacaccatgctgcgctctctgaaggaggccatggtgagccgcctgtctgccaccctccacgacccgcggtacgtcttcgccacgctgctggatcctcgctacaaggcctccctgtttacggaggaggaggcggagcagtacaaacaggatttaatcagggaactcgaactcatgaattctacctcagaggacgtggctgcctcccacaggtgtgatgctggctccccgtcgaaagactctgccgcagaggagaacctgtggtcacttgtggccaaggtgaagaagaaagacccaagagaaaagctgcctgaagccatggtgcttgcgtatctggaggaggaggtgcttgaacacagctgtgacccgctcacctactggaacctgaagaaggcgtcctggccggggctgtccgcgctggccgtcagatttttgggctgccccccaagcatcgtcccttcagaaaagctgttcaacacacccactgagaacggtagccttggccaatccaggctcatgatggaacattttgaaaaacttatctttttgaaagtgaatcttcccttaatatactttcagtattgaaactcacgacggcaccactaggccagaggcgtggctgccccagcgttagcagcctgtaccaggtctatgacccgctctgcccacggctgtgtacgacatcagaccaggcactctcagggccgctctccagctcaccacagtgtctccacgtgccttaccccttctccttcaggccaagtttcgcggggtgttttattaagacgtccactagaaatagcttgtcctgtcaactatgaatatggtgactagattttaattcataaccgtaaagttttttaaagttttgggttagtaatttgttttactagaatgacaaagaagatgtaaaccattttattctgtaggctttttactcaattatgtacaaaccacaaatcaggtactgtattttagtgaagcattgctttaattgcaacagaatagcttttgtggctatcaaatgaaatctgtaaataggaggtggagggcaagccatcctgactgagcagtttttaaccgcaggttctaaagtgtcccgcggagtacagataatattctggaaggtaactgtttactacgacagagacgtggcatttggaaacgaaacttagatgtttcatggagcttattttgagaactttcccatttcaggtttctgcattcaggctttacatggtcagttaactcagagataccccagctgtttatcatcagctcctctgaaatgtgatccctttgtaactgtgctcatcacttcgccagtgcgttcaatgacacgctgatggcaggtggtccctgctgaaacccccacgcctccgcttcagcatctccacgctctgaagctgtctttcaaaatgtgtgcactgacccccttgtttgatcaaatttgtgtaaaatttttttagaagagatggcttattaacagggaagaagcttgttatattccagttgtaagaatagccttagtgtttagatttttttatgatagggaagatgcggccatcactgggatattttcaaatcccaaggacatcagagtgaagtgtcagttgtcagatgattttaaaagttatgtcttcagagaaaaaaagattcattttctcattttaagccaattaaatattctgagtgagactaatcactcatttgcctacgaccttttagaaaagttgttttgttgaaatactgtacatacgcttaatctaaatttgcattgactatgttttagtgtatttataaatggtgaactcagtttctgaaattaaacttcttatttgcaatttt

SEQ ID NO: 1541 - DNA, 6828 bp, Homo sapiens
aatctcccaaggcctaaggaggcaagaggcctgcaaatcgcctcctgctcagcaaacgggttgctcagcaggcccggggtcctggtccaccccaggtccctggtttgcccacctccgatggcggccttcgctggcagggtgggcgcctctggggagccagctccgtcccggcgcctttagagccccatctcttccacgtccctggccttcctccccttccaggcggctgtccccgccggggtccagatggtgtcggagggccggcggttcgacggcgggcccggggttcagcctcccggcctccctccgtccctgactctcctttcttcggagagggcgcgggggccggggccaaagcgccgctcttggggttctcctggactcggagttgccccaggcgggcgcagctctgccccgcggggtgccagcctcgggcgggcaaggtccgtgagtcaccgcctgtaaccgaacaccaggcctccctgccccctcccccagctccggccgccaggctgcggcgacacctacaagaaaatgaaggggcgcccaggcccgcggcggccccggccgtatcgcgagcaggtcccggcggcccccggctcgcggcgctctttcttccccggccccggggctcggccagccgcaaccgccgccccggcgccagcaggaatccaggccgagcgaccggccccggagcccgaggcggcggagggcccgcggtagctgcgactggcgagcccgagagcgcccggggagggggcgcccggcttggaatttcccggtcccttccggcccagcgaggacaaagcactcctggccgccgccgccgccgccgccgtggcctacgccgcgccgcacaaagggcgagtcgcgacacgctcccatccccctcccagctcacggcggccccggccccgggtggctgcagggaggtgggggaagccctggctgcaccgcccctcgctccccctcccctggggccgcgcgagcgccgcccccgccccgtctgcgcgtcctcccggggaggggttggggggcgcggcgccccacataacactccccctcctgcgctgcgagccaccctctcccctccctcctgcaaacaccaccgcctcccctgccaccgccgccacctcgcccgacgctccacagctcgccgcggccggggggcggtgcgcggaccgtgcgcgccgcgggcgccagatgtgcagtccccgccgccgccagtgaccgagccgcagtccgagcggtatcgggccgcctccctgatgctgcgggggcgaccttgagcgtacagcggcttccctcggtggggaccccgacatcccagcgctgtgcccggtcttgccctctgtagcccggctcgccccgcgcttggacatggaaggggccgccgcgcctgtggcgggggaccgccccgacttggggctgggggcgccgggctctccccgagaggcggtggcgggggcgactgcagccctggagcccaggaagccgcacggggtgaagcggcatcaccacaagcacaacttgaagcaccgctacgagctgcaggagaccctgggcaaaggcacctacggcaaagtcaagcgggccaccgagaggttttctggccgagtggttgctataaaatccattcgtaaggacaaaattaaggatgaacaagacatggttcacatcagacgagagattgagatcatgtcatctctcaaccatcctcatatcatcagtatttatgaagtgtttgagaacaaagataagattgtgatcatcatggaatatgccagcaaaggggagctgtacgattacatcagtgagcggcgacgcctcagtgagagggagacccggcacttcttccggcagatcgtctctgctgtgcactattgtcacaagaacggtgtggtccaccgggacttgaagctggaaaatatactgctcgatgacaactgcaatattaagattgctgactttgggctttccaacctgtaccagaaggataagttcttacaaacgttttgtgggagtccactctatgcatctcctgagattgtcaatgggagaccttaccgagggccagaggtggacagctgggccctgggtgtgttgctttacactcttgtttatggaacaatgcccttcgatggtttcgatcacaaaaacctcattcggcaaatcagcagcggagagtaccgggagccaacacagccctcagatgctcgaggactcatacggtggatgctgatggtgaaccccgatcgccgggccactattgaggacattgccaaccactggtgggtgaactggggctataagagcagcgtgtgtgactgtgatgccctccatgactctgagtccccactcctggctcggatcattgactggcaccaccgttccacagggctgcaggctgacaccgaagccaaaatgaagggcctggccaaacccacgacctctgaggtcatgctagagcggcagcggtcgctgaagaaatccaagaaagagaatgactttgctcagtctggtcaggatgcagtgcctgaaagcccatccaagttgagttctaagaggcccaaggggatcctgaagaagcgaagcaacagcgagcatcgctctcacagcactggcttcattgaaggtgtagttggtcctgccttaccctctactttcaagatggagcaggacttgtgcaggactggcgtgctcctcccaagctcaccagaggcagaggtgccgggaaaactcagccccaagcagtcggccacgatgcccaagaaaggcatcttgaaaaagacccagcagagagaatcaggttactactcttccccagagcgcagtgagtcttcggagctgttggacagtaatgatgtgatgggcagcagcatcccctcccccagccccccggacccagccagggtaacctcccacagcctctcctgccggaggaagggcatcttgaaacacagcagcaaatactcagcgggcaccatggacccagccctggtcagccctgaaatgcccacactggaatccctgtcagagcctggtgtccctgccgagggcctctcccggagctacagccgcccttccagtgtcatcagcgatgacagcgtgctgtccagcgactcttttgacttgctggatttgcaggagaatcgccctgcccgccagcgcatccgcagctgcgtctctgcagaaaacttcctccagatccaggactttgaggggctccagaaccggccccggccccagtacctgaagcggtaccggaaccggctggcagacagcagcttctccctcctcacagacatggatgatgtgactcaggtctacaagcaagcgctggagatctgcagcaagctcaactagcattccagggcgcccaggggcgggcgggggtacgagggaggaaggggagcaagacttgggctcacaggctggttacctctttgctggctgtgacaacagactgaaaaaggattggcactgtctcacttggccaagtttgcagccttgagccaacacctaaaagggagaggtgggctcttctgccagttctgtcaattgtcagtcagaatttgggccctgtttggcatttgctttatggcacctcctagaggaccagctgtccaggggaggtggtattgaccggcactcagtgggtggagaggaagcatatgtggaaggagcatttccttagaaatgcttcattcatccagatgcttctggaggaggggcaggagacacttgggctgtttgccttgggcgagcccaaagaacttgccccttttctccttgcattagcaagctaggtctggctgcgtggagctggcaagtagatttcagcaacttgagcttgagttgatgatcaattaatagtggctgccagttgtgctggcgtaagtggcccacatcatggggaaggagtgctgtgattgactagtaatggctaccacgggaaagggaaggggaagcagtagcactaatgctatgtagttgtcatctttgatctggctaggccctgggaatcgggtttagtcatcctgtgggatctgtgttaactctttcatgccactggtgaggcatttgttaatttgctactcaactttgaggaaagacagggccttggtcagagagagaatgctctgaactctgctaaggacatagagtcagcccatggtgatttagctccttgctgttcacctcctctttcctgatgtctgccttgctctacagcacaacctcttgagggtggacagggagaaagatgatggtgtcagaggtcaaaactattatatatgacagggcacaagatggtctgtgatctttgcacagatgaatggaagttgatgcacaccaacaagaggcaacttgtcactttctttctcaatattaactggaatgctgcctcttgggttctcacctgcatggatgctttgagttggatgtgatactgtccatattctccagaggattacctggctgaaccattggctctgttcaccagtgacagatggtttccccatccactgagtgtagcatcctcagaggtaggcaagtttgcttctagggagttagcatgtagatgggatattgggatgaggaaaggaaaatcaggtagatggtgctttttttcccccaaatctaagtattctatgtcatggttttaaactttgccatgaactcctgggctttgggggaagagaaagttccattcatttaaatgaataaggtgttgaaagagtgcagggggttgggaggaagcatgtaagagagggaacatttccttagatgttacccagatggttctgggggagacagaaaagaggtgcggcaggactcttatcttaaaaagtaaacaaaacaaaacaaaacaaaacaaaaaaactagatatgtaatttctaaacacccagatcacaatgacaagatgccactccaaccatgggacaccttcatgatactaggtttgtacttcctggtctctgggatgacttcagattctgctggccaaggcaaattgaactcagttcaagatggccaccactggtagacgtgtagatagaaaagaggactggtcttgggaacatctttggaaaaaccaacaaacaatagttctagggagatgagaaaaaaattcaccttacagtgctaagaaagtgcattagaatggaattgccctttccttaaggagacagtttgggctctccccttgccaccggctctggtgttttggcttatgcgttccttcaggttgagctgagcagtgtgttatgggaagctgctcaatttcctttcattcaattccacctccttcctgaactctaatagaggttaaaagggaaaaaaaaaattctgtagatagcaaattgtgtgtgtgggggggggtgggggtgtgggtgcatggaggacaacctgcaactctgagctccctacttcctgcctcatttcatgcagtcttttctgaacagcctatgctgctgccctgctggccccttgtgcacggcagctggccgtgtccgtagctgtcagtatgacttagatctagctcctacctactggttgatgtgttttttccttttgccaagtgattgagtctgtttagtagtttccatcattctagtctttaagtaaaaatgacactattgaggaaagtcagtctactcccttcttcctccccccaaacacgtgttctcttttgtcaggaaactcagccagtgggctgtggcagagaaagtcctccactcagaggcagagactgagttaagtcataggtggccttaggcatctgcattgtttgcaggggttaagttttccttccagtgagggctggagggatgaattagctggtacctgaagccccgcttagctctgacactctgccaacatcctctgattctaggtgtggtgttgactgtcctttcaaggaaaaacttgcaatagagggaaaagccattaaagcagctccctgcttcatcattaagtcctgtcatccctaccagccaatcccagtcaaagaagttatgctttattcacttctgtggaattacaagtgagagacacttttaggacctgatggacaaagcaggagattcactgtcagctttcctggtcctctccttacttctgtgggccttgcaccgtcttagtttacacatctgccaaaggggtagaattacacttctttttacaggtaaatgtcaaggcacaatcagttttcaggaagtgcttcaagaccccaggtgaaatgaaaatgctaagtaccctctgaatggccatgcctgttaccaggtgctgcttcttcagatgatggggagcacttttcagggtgaaattcaggcgagttttgcccaggcctgctgtcttgagtacaaatgtgaatgatcgactgactgcttgttgccaaactggaaatgttctgtagggatttactggcatggtatcattcctagaagaaaaaaagagagaaacttgactgcacattaaaaaaaaaaaaatccacattgtgacttttatttaatttctattttttttggtaataaaaagttgacttttttatttgaatttgtcttttttatttattggtctgaaaggcatttcaaaggtattataataatatattggtgtaatttaattggtgcaacatgctttatggctcctgtcaaaattggttttcactcatttgattggtttgagcccagaacagcctacaggggaaaaacaagctggataaccacccaaagtgtttgtattttcgttggaaactgatttttgtttcattttggtttttgtttctgtttttatttttaaattaaataaattgcaatgaactg

SEQ ID NO: 1542 - DNA, 6415 bp, Homo sapiens
caggccttgtcatctctcacctggactgctgtgaccttcattcattcccaggagaagtccagaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcaaacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccagtcagactgaagtgttccaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcatcgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagcccttgttctgccagctggagccaagaagcacagagacacagaggcacctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggatgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccattcccctgttttcagggacctctgccttctcccacaccccttacactagtgaggactccttcggcctcttgtgttttcttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacgtgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattgtacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagcacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctg

SEQ ID NO: 1543 - DNA, 5547 bp, Homo sapiens
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatattaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcatcatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatcctggaaaagtctccacttcccattgtccggtctaacctcatggttgccactggggatctggccatccgctttcccaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatccctaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtaggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctcttttttttaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttt

SEQ ID NO: 1544 - DNA, 6149 bp, Homo sapiens
cccaaatctattaaagcagcaccctgataccacttactctgttgcattgttatgaagacttaaggtaacagagctaaacaccagtgcactgcctgtaacagagtgagcacacaataacttacagctcttactgtttacagtgataaccagctacttaatacctggctcatgtttccatgtgccacttgtttcttggtaacaaacaagagtcatggaaatcatgggatgtacagtcagaatggtttcccttgtcctagaatttggataaacctaatgaaatataaaagcaagttgagtttccctagttctgggtggcagggtcctatttaagagagagaagggaatggggaagataagcccagcattactttccaccggctccatccaggagtaaggccaggtgactttggggatgccagttggtgggtagagagcagcgtggctgtgtgcagtgggtaccagcgtggcctggcaccctgggcttcatgctgtgcttcctctggaggcctgggctgagacagtgctcttggtatcctgtgctagattcctaacactgattagtagcatctcttctggcctctggtgtgcttggcttccctaggcatgcagtaccataagctgacagagcacttcgatgagaagcctttctcctgtgaagagtgtggggcgaagtttgcagccaattccaccctgaagaaccaccttcgccttcacaccggggaccgcccgttcatgtgcaagcactgcctcatgaccttcacccaggcctccgccctggcctatcacaccaagaagaagcactcagaagggaaaatgtatgcatgccagtactgtgatgctgtgtttgcccagtctattgagctgtcccgccacgtgaggacccacaccggggacaagccctatgtctgcagagactgtggcaagggcttccggcaagccaatggcctctccatccatctgcacacctttcacaacatagaagatccttatgactgcaagaagtgcaggatgagtttccccactcttcaggatcaccggaagcacatccatgaggtgcactccaaagagtaccacccctgccccacgtgtgggaagatcttcagtgccccgtccatgctggagcggcacatggtgacccacgttggagggaagcccttcagctgcgggatctgcaacaaggcctaccagcaattgtctggtttgtggtaccacaatcgaacccaccaccctgacgtatttgctgctcagaaccaccgatcttccaagttctcatcactccagtgcagctcctgtgacaaaaccttccccaacaccattgagcacaagaagcacatcaaagcagaacatgcagatatgaagttccatgaatgtgaccagtgtaaggagctcttccccacgccagccttgctgcaggttcatgtcaagtgccagcattcagggtcccagccattccggtgcttgtactgtgctgctactttccgttttcctggagcattgcagcaccatgtcaccacggagcacttcaagcagtcagagaccaccttcccctgtgagctctgtggggaactcttcacctcccaggcccagcttgacagtcacctggaatctgagcacccaaaggtgatgagcacggaaacccaggccgcagcctcacagatggcgcaggtgatccaaaccccagagccggtggccccgacagagcaggtgatcactttggaggagacccagcttgccgggtcgcaggtgtttgtgacgttgccagattctcaggcatctcaggccagctctgagctcgtggcggtgactgtggaggacttgctggatggcacagtgacgctgatctgtggtgaggccaaatgagcagcctttcatccggcagagccttcctgcgtttgcagcagagaggaggccccacagcttgccctttgccctccatccctggctgtcctgagtggtgagcatcttagcttagcaccaaccaacacagtctcacctagaaaacagatggaagcttcgttgttctcatagaaccaacagcatctgagccctcaacaccaacagcaccatcctctgtagcagacaggcctccctccccacaggcccgctgctgcggcctctatgacactgtccatccccaagtgacatgtggcttcagaagtagagtctgaaagagcagtgggatgggagctggtgaccagggtaccccaggaggcatgatgtgccgacagcgctcagtgggcagaatggcagttagatatgggacttggcccacagtgggggctgcaaatgctgccactgcctctggccatttaaagtgagaggggcaccaacagacaattcggggaccttaggccccttcctgaggcacacttggccccttcctcggtcctatcatcctaccctctgctggggttccccctccacccagtggccacgcccagcaccctattgatggctataggacaggtagccctcatttccatgcctgataaccccttgtcagttgtcagctcttcccaaaacaaagctctggagtttctgctggaagtgtttaatgtgaggcatcagctgctagacagtgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtgagtggcctgctgcctcacctcccgcaggccgccacacttattgcaggtcagtgatcctttggagtttgaatttcacaaagctttttttatcttcagttcctaaaatataatctgataattaatggtttgtggaatccattatgaagtgcaattagatagatgtaggttcctgccgtttggagagaatgactagcatttatcttcttttccttccatgccaaaggttggagtctgctggtgcggtgtttacacaccaggcagggctgtctgccaccttgtgtggcttgaccccctgtggaggggagtgcctggttggatcccacactggcagagatggggccaccccttccttccaggcacatctcacattgccatgtacagaggcaggagtcacgtttggtcaccatggaagcttttattgctcccacatggtcaggtctcaccctgcttgaagcgcagaaggcacagccttactgaccagcacgcccactgactggcatctgccggctttgtgcaggcagccccgacggtttccacagcgagcgccagctccggccagcctgggacagctcatcccagccgactacacctgcttctggtcctgtccacattttgatacgcagatcacttgagcttgtcaattagggttctgccattctgaaataaatgaagtttctaaagcagagtcggcctcagaagccaaaaactgaccagaagatggtgctcaaacctttaagacttcatctccatgtgaagggctcactgtttctaccaaggctgtgcctgtattaaggcttttccgtcctgggaactgtcagtctgggagagctcttgatctgcaggtggcaaaatggcactgaatatccccttggcagcagagaaaacccactgaaagatcgtagagtggcacatgcttacagggcattggtgccaagtccagtggatgagaatccagcccctcacaagctgtgggatggggcttgggagttgcagtgaatgtcattaaaatttcttccaaaacaaaactagaaataattgctgagggcttatagggaagtgatttaaaaagaaaaaacaaacaacaacaaaaaaaactcttcggaataaagagggctgtaaattttgaattccagtgtcagatcctttcaagcactgagaaattctttctcaggtttctttttttgggggagacagggtcttgctctgtcacccagactggaacacagtggcacgatcttggctcactgcaacctctgcgggctcacgcaatcctcctgccacagcttcccaagtagctgggaccacaggcgtgagccaccactgctggccagtttttgtatttttttttttttttgtagagacagggtctcgccatgttgcccaggctggtttaaaactcctgagctcaagcagttctcccacctgggcctcccaaagtgctaggattacagacatgagccactacgcctggccaggtttctgttggagacccagattgtgacaagacatttgttttcttcggaatcaccagatttgcagcttactgtgccgagagtggactggctgccggggcccatcagatgccctctggcccatggcacactcagcagaaggcacaaacccagtgctggttctcatcaagaaagaggggaaggcccttcccgagtttactgtctgctctgagtgggctccgcactggctgactgattttatagtcttgctctctagagaagcccaggcatggatcttataggaaaactttctgactctgcttggccattttatccttttctcctacttctgcccaagagacctgaattgctgccatagaggacagtgtttgtgtggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgctcccagagctcatggcccaggtggtgaggagggaaaggcagtcagattccaggctggagtgtgattctgtgggaatactggggtcagttatggaacaggacttgcccattataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgtgcctggaagctgcacattgaccaaaggagggagggaagtgctaaccatgtatagagtgggcaggcggttccagggagacaagcagcatgttattaaattgggcctaggcagttggacgataatggagaaaaagcagggatgctataatgagtcctccccaagggtgagttcagcaccccagccctgttctgcttgtatcccagtgatacttgggaggtaggaagaaaatgggagtaagagaacaatttggggctgaagggagtgtcagaggcacgttgatccttgttttgttgtcatggaaacttcggggctggtgggacttaggccaaaagctcagaggcacagccaaaatttagaagcttgctactcctacgactcggcctataaggaagagagaagctgtctgtactttggggactacattgctgaaggaaaaaaatcactccctggctaattaagattgcttccaaattgggggaatgtgtgtcatttcctttaccaaggccagtcatccctgcttccacccatggtcaggacagtcagccactacgtgatgctgtataaattggattacaaaccatattcttgttcagcttgcactaatctatataaataaaatatgtactttg

SEQ ID NO: 1545 - DNA, 6586 bp, Homo sapiens
ctggggagccggcgctggaggtggtgagtggcgtggggactgtgtcgagggggtccccaaggtgccggaccctgcggaggggcgaagtttcggcactggggagggcgtgcggacgctttccctacaggcgaccactgctctgcgggcgggtggtcttagctccagtcccccattcagttcctcagcattccaggtcggcggcgaaggggtccccgaacgaagggcgcaaggcagcgtctctgctgggaccgggaagccggacttcagggcctctcggcccgtgggcttctccccgagtctccccgagtcggttggcattaagagtttagcagatactttcagaaatggatacataagaaatggctggaaatcaaatgaatgtccaaagaagagcttagggtcttagtaacattcttttttaaaataactgtctgccaaaatgtcattacacagtactcataatagaaataacagcggtgatattcttgatattccttcttcccaaaatagttcatcactgaatgccctcacccacagtagccgacttaagctgcatttgaagtcggatatgtcagaatgtgaaaatgatgatccattattgagatctgcaggtaaagtcagagacataaatagaacttatgttatttctgccagtagaaaaacagcagacatgccccttacccctaatcctgtaggtagattggcacttcagaggagaactacaaggaacaaagaatcatctttgcttgttagtgagttggaagacacaactgaaaaaacagcagaaacacgtcttacattacaacgtcgtgctaaaacagattctgcagaaaagtggaaaacagctgaaatagattctgtcaaaatgacactgaatgtgggaggtgaaacagaaaataatggtgtttctaaggaaagtagaacaaatgtaaggattgtaaataatgctaaaaactcttttgttgcctcttctgtacctttagatgaagatccacaggtcattgaaatgatggctgataagaaatacaaagaaacattttctgcccccagtagagcaaatgaaaatgttgcacttaagtactcaagtaatagaccacccattgcttccctgagtcagactgaagttgttagatcaggacacttgacaacgaaacctactcagagcaagttggatatcaaagtgttgggaacaggaaacttgtatcatagaagtattgggaaggaaattgcaaaaacttcaaataaatttgggagcttagaaaaaagaacacctacaaaatgtacaacagaacacaaactgacaacaaagtgcagcctgcctcagcttaagagcccagctccatcaatactgaagaatagaatgtctaaccttcaagttaaacaaagaccaaaaagttcctttcttgcaaataaacaggaaagatccgcagaaaatacaattcttcccgaagaagaaactgtagttcagaacacctctgcaggaaaagaccccttaaaagtagagaatagtcaagtgacagtggcagtacgcgtaagacctttcaccaagagagagaagattgaaaaagcatcccaggtagtcttcatgagtgggaaagaaataactgtggaacaccctgacacgaaacaagtttataattttatttatgatgtttcattctggtcttttgatgaatgtcatcctcactacgctagccagacaactgtctatgagaagctagcagcaccactcctagaaagagccttcgaaggcttcaatacctgtctttttgcttatggtcagactggctctggaaaatcatatacgatgatgggatttagtgaagaaccaggaataattccaagattttgtgaagatcttttttctcaagtagccagaaaacaaacccaagaggtcagctatcacattgaaatgagcttctttgaagtatataatgaaaaaattcacgaccttctggtttgtaaagatgaaaatgggcagagaaagcaaccactgagagtgagggaacatcctgtttatggaccatatgttgaagcactgtcaatgaacattgtcagttcttacgctgatatccagagttggctagaattgggaaataaacaaagagctactgctgctactggtatgaatgataaaagttcccgatctcattcagttttcaccctggtgatgacccagaccaagacagaatttgtggaaggggaagaacacgatcacagaataacaagtcgaattaacctaatagatctggcaggcagtgagcgctgctctacggctcacactaatggagatcgactaaaggaaggtgtgagtattaataagtccttgctaactttgggaaaagttatatctgcactttcggaacaagcaaaccaaaggagtgtttttattccttatcgtgaatctgttcttacatggctgttaaaagaaagtctgggtggaaattcaaaaactgcaatgattgctacgattagtcccgctgccagcaacatagaagaaacattaagcacacttagatatgctaaccaagcccgtttaatagtcaacattgctaaagtaaatgaagatatgaacgctaagttaattagagaattgaaggcagaaattgcaaagctaaaagctgctcagagaaacagtcggaatattgaccctgaacgatacaggctctgtcggcaagaaataacatccttaagaatgaaactgcatcaacaggagagagacatggcagaaatgcaaagagtgtggaaagaaaagtttgaacaagctgaaaaaagaaaacttcaagaaacaaaagagttacagaaagcaggaattatgtttcaaatggacaatcatttaccaaaccttgttaatctgaatgaagatccacaactatctgagatgctgctatatatgataaaagaaggaacaactacagttggaaagtataaaccaaactcaagccatgatattcagttatctggggtgctgattgctgatgatcattgtactatcaaaaattttggtgggacagtgagtattatcccagttggggaagcaaagacatatgtaaatggaaaacatattttggaaatcacagtattacgtcatggtgatcgagtgattcttggtggagatcattattttagatttaatcatccagtagaagtccagaaaggaaaaaggccatctggaagagatactcctataagtgagggtccaaaagactttgaatttgcaaaaaatgagttgctcatggcacagagatcacaacttgaagcagaaataaaagaggctcagttgaaggcaaaggaagaaatgatgcaaggaatccagattgcaaaagaaatggctcagcaagagctttcttctcaaaaagctgcatatgaaagcaaaataaaagcactggaagcagaactgagagaagagtctcaaaggaaaaaaatgcaggaaataaataaccagaaggctaatcacaaaattgaggaattagaaaaggcaaagcagcatcttgaacaggaaatatatgtcaacaaaaagcgattagaaatggagacattggctacaaaacaggctttagaagaccatagcatccgccatgcaagaattctggaagctttagaaactgaaaagcaaaaaattgctaaagaagtacaaattctacagcagaatcggaataatagggataaaacttttacagtgcagacaacttggagctctatgaaactctcaatgatgattcaggaagccaatgctatcagcagcaaattgaaaacatactatgtttttggcagacatgatatatcagataaaagtagttctgacacttctattcgggttcgtaacctgaaactaggaatctcaacattctggagtctggaaaagtttgaatctaaacttgcagcaatgaaagaactttatgagagtaatggtagtaacaggggtgaagatgccttttgtgatcctgaagatgaatgggaacccgacattacagatgcaccagtttcttcactttctagaaggaggagtaggagtttgatgaagaacagaagaatttctggttgtttacatgacatacaagtccatccaattaagaatttgcattcttcacattcatcaggtttaatggacaaatcaagcactatttactcaaattcagcagagtcctttcttcctggaatttgcaaagaattgattggttcttcgttagatttttttggacagagttatgatgaagaaagaactatagcagacagcctaattaatagttttcttaaaatttataatgggctatttgccatttccaaggctcatgaagaacaagatgaagaaagtcaagataacttgttttcttctgatcgagcaatccagtcacttactattcagactgcatgtgcttttgagcagctagtagtgctaatgaaacactggctgagtgatttactgccttgtaccaacatagcaagacttgaggatgagttgagacaagaagttaaaaaactgggaggctacttacagttatttttgcagggatgctgtttggatatttcatcaatgataaaagaggctcaaaagaatgcaatccaaattgtacaacaagctgtaaagtatgtggggcagttagcagttctgaaagggagcaagctacattttctagaaaacggtaacaataaagctgccagtgtccaggaggaattcatggatgctgtttgtgatggtgtaggcttaggaatgaagattttattagattctggactggaaaaagcaaaagaacttcagcatgaactctttaggcagtgtacaaaaaatgaggttaccaaagaaatgaaaactaatgccatgggattgattagatctcttgaaaacatctttgctgaatcgaaaattaaaagtttcagaaggcaagtacaagaagaaaactttgaataccaagatttcaagaggatggttaatcgtgctccagaattcttaaagttaaaacattgcttagagaaagctattgaaattattatttctgcactgaaaggatgccatagtgatataaatcttctccagacttgtgttgaaagtattcgcaacttggccagtgatttttacagtgacttcagtgtgccttctacttctgttggcagctatgagagtagagtaactcacattgtccaccaggaactagaatctctagctaagtctctcctcttttgttttgaatctgaagaaagccctgatttgttgaaaccctgggaaacttataatcaaaataccaaagaagaacaccaacaatctaaatcaagcgggattgacggcagtaagaataaaggtgtaccaaagcgtgtctatgagctccatggctcatccccagcagtgagctcagaggaatgcacacccagtaggattcagtgggtgtgaatactgatgtgtaggcacttttatgaccacccatgaaagaaaaagaacacttgctcggtaattttctttatgcaggagagtttaagagaaatcagcacagatatttcaaaaaagtccatgtctttttatctttaaaatatctatttatcaaaggccagacacagtggctcacgcctgtaatcccagcactttgggaggcgggcagatcacaaggtcaggagtttgagaccggcctggccaacatggtgaaaccccgtctctactaaaaatacaaaaatttgctgggcatggtggcgcgtgcctgtaatcccagctactaggggggctgaggcaggaggatcgcttgaacctgagaggcagaggttgcagtgagccaagatcatgccactttactccagtctgagcaacagaacgagacttagtcaaaataaataaataaataagtaaataaataaataaataaaatatcttttatctttaaagtgtttaacattggtatactgtctgtagttggttcattagtcgtttataaagggttattttctcatgagtggaaacctgaacaatcagttacctttgtgcctatgccttctctctcctcagacagctgggatgtttatggtgaaatggcctgtacaagtttaactaagacaacttaacttgcattgttaatcaaaaattcttttctcaaagggttaactggttgccattttgaatagtatgttcaagggtgtagcttcctgtttctttccaaattataagtagctacctaaatatagtataattatatattaataatatggcttgctggcacagtagtttaccctgttatctgtgtttcataatgggggctgtatgaatattatttaaaactaataaaatgttgccagaattatactaaactgttggatgagattaggagatcagaggctggaccttctcttgataatgcttgttttgttaaaggtataatgaaataatttgtatatgatttgatgaagattaaagacccttattttccacagctttaaaaaaaaacctttatttatgatcaagtaataaagataatattctacttgtgggatcttacattatggaaatagtttgacgtttttgacctcaagagtatgtataatttgaagagatactttgtaactatgcttgggtgatattgagcagttcctaaagaataattcattt

SEQ ID NO: 1546 - DNA, 2112 bp, Homo sapiens
ggaagttaaagggaaaaagcaattcacaggaaagagtacaaagacagcacaagaaaaaaacagatttcataaaaatagtgattctggttcttcaaagacatttccaacaaggaaagttgctaaagaaggtggacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccaagaagcccaaatgggatgacttcaaaaagaagaagaaagaactgaagcaaagcagacaactcagtgataaaaccaactatgacattgttgttcgggcaaagcagatgtgggagattttaagaagaaaagactgtgacaaagaaaaaagagtaaagttaatgagtgatttgcagaagttgattcaagggaaaattaaaactattgcatttgcacacgattcaactcgtgtgatccagtgttacattcagtatggtaatgaagaacagagaaaacaggcttttgaagaattgcgagatgatttggttgagttaagtaaagccaaatattcgagaaatattgttaagaaatttctcatgtatggaagtaaaccacagattgcagagataatcagaagttttaaaggccacgtgaggaagatgctgcggcatgcggaagcatcagccatcgtggagtacgcatacaatgacaaagccattttggagcagaggaacatgctgacggaagagctctatgggaacacatttcagctttacaagtcagcagatcaccgaactctggacaaagtgttagaggtacagccagaaaaattagaacttattatggatgaaatgaaacagattctaactccaatggcccaaaaggaagctgtgattaagcactcattggtgcataaagtattcttggacttttttacctatgcaccccccaaactcagatcagaaatgattgaagccatccgcgaagcggtggtctacctggcacacacacacgatggcgccagagtggccatgcactgcctgtggcatggcacgcccaaggacaggaaagtgattgtgaaaacaatgaagacttatgttgaaaaggtggctaatggccaatactcccatttggttttactggcggcatttgattgtattgatgatactaagcttgtgaagcagataatcatatcagaaattatcagttcattgcctagcatagtaaatgacaaatatggaaggaaggtcctattgtacttactaagccccagagatcctgcacatacagtacgagaaatcattgaagttctgcaaaaaggagatggaaatgcacacagtaagaaagatacagaggtccgcagacgggagctcctagaatccatttctccagctttgttaagctacctgcaagaacacgcccaagaagtggtgctagataagtctgcgtgtgtgttggtgtctgacattctgggatctgccactggagacgttcagcctaccatgaatgccatcgccagcttggcagcaacaggactgcatcctggtggcaaggacggagagcttcacattgcagaacatcctgcaggacatctagttctgaagtggttaatagagcaagataaaaagatgaaagaaaatgggagagaaggttgttttgcaaaaacacttgtagagcatgttggtatgaagaacctgaagtcctgggctagtgtaaatcgaggtgccattattctttctagcctcctccagagttgtgacctggaagttgcaaacaaagtcaaagctgcactgaaaagcttgattcctacactggaaaaaaccaaaagcaccagcaaaggaatagaaattctacttgaaaaactgagcacataggtggaaagagttaagagcaagatggaatgattttttctgttctctgttctgtttcccaatgcagaaaagaaggggtagggtccaccatactggtaattggggtactctgtatatgtgtttcttctttgtatacgaatctatttatataaattgtttttttaaatggt

SEQ ID NO: 1547 - DNA, 1024 bp, Homo sapiens
ggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggaaaaaaaaaaaaaaaaaaaaaa

SEQ ID NO: 1548 - DNA, 3432 bp, Homo sapiens
  Modified_base 2740: n = a,c,g, or t
ctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaagacacgaataatctgttcagcgtgcagttccgtaccactcccatggacagtactggtgttcctcacattcttgagcataccgtcctttgtgggtctcaaaaatatccgtgcagaaaccctttcttcaaaatgttgaaccggtccctctccacgttcatgaacgccttcacagctagtgattatactctgtatccattttccacacaaaatcccaaggactttcagaatctcctctcggtgtatttggatgccaccttttccccatgtttacgcgagctggatttctggcaggaaggatggcggctggaacatgagaatccgagcgacccccagacgcccttggtctttaaaggagtcgtctttaatgagatgaagggagcgtttacagacaatgagaggatattctcccagcaccttcagaacagacttcttcccgaccacacgtactcagtggtctccgggggtgacccactgtgcatcccggagcttacatgggagcagcttaagcagtttcatgccactcactatcacccaagcaatgctaggttcttcacgtacggtaattttccattagaacagcatctgaaacaaattcacgaggaagcactgagcaaattccagaaaattgaaccaagcaccgtggtgccagctcagacaccctgggacaagcctagggaattccagataacatgtggcccggattcatttgctacagatccctctaaacaaacaaccgtcagcgttagcttcctcttaccggacatcaccgacacatttgaagccttcacattaagtcttctgtcttcactcttgacttctgggcccaattctcccttttacaaagccttgattgaatctggccttggcacagaattttctcctgatgttggatataatggctacacgagggaggcctactttagtgtcggcctccaagggattgtggagaaagacattgagaccgtcagaagcctcatagacagaacgattgatgaagtagttgagacaaggattgaagatgatcgaattgaggctttacttcataaaattgaaatacagatgaaacatcagtctaccagctttgggctgatgctgacatcatacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcatcctcaccaagctgggctgcggccttcttgactaccgggagcaggctcagcagatagaattgaagaccggagggatgagtgcttctccccacgtgctccccgacgactcacacatggacacctacgagcaggtaggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccgcgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggangcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgataggtacctcggcactgggaagagcacacacggcctggccatcctcggacccgagaacccgaaaattgccaaggacccatcctggatcatccgatgagcagccgtggcgctcgactgcacaggagcccgagacaatacacctccaagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctgattctagaatatttaagaatctaaaaataaagggcaactctgactta

SEQ ID NO: 1549 - DNA, 4606 bp, Homo sapiens
cgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgcgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctctcaccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaagcgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctacgccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgcttgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaaaaaaaaaaaa

SEQ ID NO: 1550 - DNA, 5047 bp, Homo sapiens
gctggatcctgcagtaaccacaacagcatcctctccctgcgccagggacctgccagccggagagatgactgattagatcagattagatccggagccccgctctgcagaagggggccccaggggcgggggaggaggaccccagctggcctgagctggggggaggggtgccttggggctcgcagagttagagctttccagcgcggggatcacacctcagaagccgccacaatgaaagacggaacacatttctacacccagtgactggccaggtcccagaggaaaacaaaaaatttgacttgaaaatatcgaccttggacatgtccaataaaacaggtgggaaacgcccggctaccaccaacagtgacatacccaaccacaacatggtgtccgaggtccctccagagcggcccagcgtccgggcaactcgcacagcccgcaaagccatcgcctttggcaagcgctcacactccatgaagcggaaccccaatgcacctgtcaccaaggcgggctggctcttcaaacaggccagctccggggttaagcagtggaacaagcgctggttcgtcctggtggatcgctgcctcttctactataaagatgagaaggaagagagtatcctgggcagcatccccctcctgagcttccgggtagccgcagtgcagccctcagacaacatcagccggaaacacacgtttaaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagccatgagaagccagactcggagaacgtcccacccagcaagcaccaccagcagccaccccacaacagcctccctaagcctgagccagaggccaagactcgaggggagggtgatggccgaggctgtgagaaggcagagagaaggcctgagaggccagaagtcaagaaagagcctccggtgaaagccaatggcctcccagctggaccggagccagcctcagagccgggcagcccttaccccgagggcccaagagtgccagggggtggggaacagcctgcccagcccaatggctggcagtaccactccccaagccggccagggagcacagctttcccgtctcaggatggagagactgggggacaccggcggagtttcccaccacgcaccaaccctgacaaaattgcccagcgcaagagctccatgaaccagcttcagcagtgggtgaatctgcgccggggggtacccccgcctgaagaccttcggagtccctctaggttctatcctgtgtctcgcagggtccctgagtactatggcccctactcctcccagtaccccgatgattatcagtactacccgccaggagtgcggccggagagcatctgttccatgccggcctatgatcggatcagcccgccctgggccctggaggacaagcgccatgccttccgcaatgggggtggccctgcctaccagctgcgagagtggaaggagcccgccagctacgggcggcaggatgccaccgtctggatcccaagcccctcccggcagccagtctattatgatgagctggatgccgcctctagctccctgcgccgcctgtccctgcagccccgctcccactctgtgccccgctcacccagccagggctcctacagccgtgcccgcatttactcccctgtccgctcacccagtgcccgttttgagcggctgccacctcgcagtgaggacatctatgctgaccctgctgcctatgtgatgaggcgatccatcagctcccccaaggtccctccatacccagaagtgttccgggacagcctccacacctacaagttaaacgagcaagacacagataagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggccctgacaaacagcaccatagagtatgagcacctcgagtctgaggtctctgccctgcacgatgacctctgggagcagctcaatttggacacccagaatgaggtgctgaaccggcaaatccaaaaggagatctggaggatccaggacgtgatggaggggctgaggaagaacaacccctcccggggcacggacaccgccaagcacagaggaggacttggcccctcagccacctacagctccaacagcccggccagccccctcagctctgccagcctcaccagccccctgagccccttttcactggtgtcgggctctcaggggtcccccaccaagcctggctccaacgagcccaaggcaaactatgaacaaagcaagaaagacccccaccagacattgcccctggacacccccagagacatcagccttgtgcccaccaggcaagaggtagaggcagagaagcaggcagctctcaacaaagttggcgttgtgccccctcggacaaaatcgcccactgatgatgaggtgaccccatcagcagtggtaagaaggaatgccagtgggctcaccaatggactctcctcccaggaacgccccaagagtgctgtgtttcctggcgaggggaaggtcaagatgagcgtggaggagcagattgaccgaatgcggcggcaccagagtggctccatgaaggagaagcggaggagcctgcagctcccggccagcccggcccccgaccccagtccccggccagcctacaaagtggtgcgccgccaccgcagcatccacgaggtagacatctccaacctggaggcagccctgcgggcagaggagcctggcgggcatgcctacgagacaccccgggaggaaattgcccggcttcgcaaaatggagctagagccccagcattatgacgtggacatcaataaggagctctccactccagacaaagtcctcatccctgaacggtacattgacctggagcctgacactcccctgagccctgaggagttgaaggagaagcagaagaaggtggagaggatcaagacactcattgccaaatccagtatgcagaacgtggtgcccatcggcgagggggactctgtggacgtgccccaggactcagagagccagctgcaggagcaggagaagcggattgaaatctcctgcgccctggcgaccgaggcctcccgcaggggccgcatgctgtctgtgcaatgtgccaccccaagccctcccacctcccctgcttccccggctcctccagcaaaccccctgtcgtctgaatccccacggggcgccgacagcagctataccatgcgggtctgagctctgactgcaagccctggctgaggccaatgctgtgaagctccacagagccacattctgaagccgtcctctgcccacctgaggtcctggctccccaccctggccccctgcccctgcactcccatgggaatgccgcagggagccaggctggggccatgggctgctgccagaggaccgtggatacctcagtgtccacacacccaccatgcccagccctggagccatcactactcacaccgtggtcctgggccagggcctgagatgacagtggggagcaccatcctcattaatgtccaagtcacagggagcctcagccttgccctggctggggttgtggtgactccagtggaacattccctgatgggggacatgccgtggtggagaacacacctgtggctatcttatgtgaggactagaggtgaagaggagatggacactgcctctggagccagcctgacaccaaggacagcacttgtcatcatccctatcctcgtcagccccaccctgctgcctcagctggacccagggctttgacacaaacccagtgctttgcttatgggtgctcgctggggtccggtggagactgaccaccctgcttgagccaaagacaaggtgatgagagatggggagaggccattggctcccagagggaacagtgctggctgtggctagagaacagcaggtctgtgcagtgtctgagggcaggttgggaagggtagcagagagagagagacagaaagagagagagagagagagagagagagagagagagagagagagagatcctcagagtggaaggagggggaagcagcaggacacattggcaagtcaagcaggaaggagggagatggaaaggggatatcagattggtttcccccggtggagccttaggttagtgcccagtgcagtgccagactgtctcctctgctcctcccacctcatccctaggaggacccaccagtggagcacatgcagcctcagtggagatgcttggtgtggggatctgggtgaagggggttgagtagcgactgcctgggagatggctgttagtaggtctgcgcctggtgtctgcctcgccatcctggggtaaggggcagagagaaggacttgtcttatgtagggtgtggtcagccttggggccttacctacccagttccatgatatttcttgccctgttccccctggaatgtgcagtgggccagctgagagtacgccttgaggaggggggatgaggccttaatctgggaggcctatccccctatcccaggcatcccagacgaggactggctgaggctaggcgctctcatgatccacctgccccgggagggcagcggggaagacagagaaaagcaaacacattcctcctcagctccacccacctggagacgaatgtagccagagaggaggaaggagggaaactgaaaacaccgtggcccctcggccttctctctgctagagttgccgctcagaggcttcagcctgacttccagcggtcccaagaacacctactaattcctctccactccttcatggctgggacagttactggttcatatgcaagtaaagatgacaatttactcaac

SEQ ID NO: 1551 - DNA, 4256 bp, Homo sapiens
cgagaccccagacgaggaccaggattcatgaaatcagtcgcaggggccggggcaggggcctctggctcccgacactggccgagaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgctaaagtggataatgagatccttaattacaaagacctggcggctctccccaaggttaagtctatctacgaggtacaacgccccgacctcatttcctatgagcctcattccagatacatgtccgacgagatgctggagagatgtggctatggagagtcgctgggaacattatctccctactcccaggacatctacgagaacctggacctccggcagagacgggcctccagcccggggtacatagactcccccacctacagccggcagggcatgtcccccaccttctcccgctcacctcaccactactaccgctctgggcccgagagtggccggagctctccataccatagccagttagatgtgaggtcctccactccaacctcttaccaggctcccaagcactttcacatcccagctggagacagtaacatctaccggaaacccccgatctacaaacggcatggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtctaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatactcccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatagggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccct

SEQ ID NO: 1552 - DNA, 5109 bp, Homo sapiens
aacaagatgagctgatagggttcccaggctgcctggagttacataacccattgtgcttccaggacagctcacaatcttaggatttgccctaacaagcaaactcagaaaactgctgaggaaggcacgggagggtggctgtgcgaggtactgccggggctgagctctcatggaggctctctctgttctctgaagtgcctttggagtttatgtctgcacatggcattggtttttcaattcgggcagcccgtcagggctcagcctctgccaggactctgccacggcaagctcattcggacaaacgcctgtgatgtgtgcaacagcaccgatcttccggaagtcgagatcattagcctgctggaggagcagctgccccattataagttaagagccgacaccatctacggttatgaccacgacgactggctccatacacctctcatttctccagatgccaacattgacctcacaaccgagcaaattgaagagacgttaaaatacttccttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcgctgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttctgccacacttcaccactggcagcagttggcccaacctcaccttgggggcatcctggacccccggcctggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccatgcggtctttgatcgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagttccagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccacaaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatgg

SEQ ID NO: 1553 - DNA, 4839 bp, Homo sapiens
gtgacagggcaccgagggaaggaggacgcgagggcagccaggccctagggagcagggagagtggctcgggctcagtcgcgtggccccaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcagatatgcagcagccacgcacatgctgagtgacatttcttccgcaatggccaatgggaactgggaagaagctaaggagctcgctcagtgtgcaaaaagggattggaacagactgaaaaaccacccttctctgagatgccacgaagatttaccactcttcctgcggtgtttcactgttgggtggatttatacaaggattttgtctcggtttgtggaaatactgcagagacttcacatgtatgaggaagccgtcagagaacttgaaagccttttgtctcagagaatttattgtcctgacagcagaggccgatggtgggatcgactggcccttaatttacaccagcacttgaagcgcctggaaccgactatcaagtgcatcacagaggggctggcggatccggaagtcagaacgggacaccgcctttcactgtatcagcgagccgtgcgcctgcgagagtctccgagctgtaaaaagttcaagcacctcttccagcagctcccagaaatggctgtgcaagatgtgaaacacgtgaccatcacaggcaggctgtgcccacagcgtgggatgtgcaagtctgtgtttgtgatggaggccggggaggccgctgaccccaccacggtcctgtgctctgtggaggagctggcactggcccattacagacgcagcggttttgaccaggggattcatggcgaagggtccaccttcagcaccctgtatggcctcctcctgtgggacatcatcttcatggatgggattccggatgtcttcagaaacgcctgtcaggcattccccctggacttgtgcacagacagcttcttcacaagcagacgcccagcccttgaggccaggctgcagctgattcatgatgcccccgaggagagcctgcgggcctgggtggcagccacgtggcatgagcaggaaggcagagtggcttcccttgtcagctgggatcgcttcacgtctcttcagcaagctcaggatcttgtctcctgcctggggggccctgtgctcagtggtgtgtgcaggcacctggctgctgactttcgacactgtcgagggggcctccccgacctggtggtgtggaactcccagagccgtcactttaagctggtggaagttaaaggccccaatgatcgtctttcacataagcagatgatctggctggctgaactgcagaagctgggggctgaagtagaagtctgccatgtggttgcagttggagctaagagccaaagccttagctaaaagattccctacaggagaaaatggaaatgaggaggagagaaactccggtgtccccgaggtgtcggtgtggtgagggccgctggcgttgaagtacatcctgctctggcccagctccccatagcaggcctccagggggccactgcgctgttgccgcagcatcctgctcagtacgtcgacttcatcagccaggagggagagcttgtgaaaggctgtgatggagccacccaggctgatctgggcctcgggaacccagcggaagtagcacagtttccacagttttatgtgtgttccagagacacgtggcagaataacaccgtgcaggttggcgggtttggaaaaccattctctaaaatactgctccgtatcactgttctggctgtcggtttgctgagctggatctggctttggttttaatatcaatgaatttctccttggaagtaattcttggtcactgatgattccattctttaaggcagacggcattcctcttagtgtggagctgtagcttttctatacagaagagattttattatgttccggggattccctttttagaaagattgaaggatgcaatggcaaatataaactcaatactatgaaaaattaatggaatttcagcctcaaagaacattttcctcccttcctttgtgtccttattctaatcctcctcccctggaattacacttttttatgtgttgactctacctaggctgttactatcagcctgaatgggggcgggatgagagtacctcctatccactaatttgcttaaggataagttctaagacgggctagaaaaaacactagacctggtcgattctatcaagaacaatggcaaactgaacagaggcagtcaggaggccaaatgtctgattctttgttctgtacctttcagtagtctgcaaattttctaccaaaaaaaaatcccaagaatttatttgggaattattaaaaaggcaaacaatgaatgttattaggacaagaatatagcagtcaggaggccatgactacatcacagccaggcggcattccctgccacagtggcggcttgaatcatcaagaaatggataaatggggctttagtaaatcaggcttgcaggctcaaagctgcaatctgcccactctcaggtactgagactttgtgggcctcagacaccaggaagaaagttgggatacagtcatttgagttaaaaagggaatgacccctcagaaacccacattagcagtgttactcttggaactgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaact

SEQ ID NO: 1554 - DNA, 2579 bp, Homo sapiens
tgagaccgtcagaagcctcatagacagaacgattgatgaagtagttgagaaaggatttgaagatgatcgaattgaggctttacttcataaaattgaaatacagatgaaacatcagtctaccagctttgggctgatgctgacatcagtaagtgatctctcaacaattttgtttttgttttataatagacattttgtcttgttactagcttaactggcattttgatatttttatgtgaaatagattactttaaatgggtaagggtttataactagtaatctgttggttatttcctaaacattatttcagcctgtgctttttattttattggaacaaaacagggctaaagtaagtttttttgtttctccatccaaagaattacatgacttttgttataaacaatcatctgtggtatatttaaatacagaaactaggattttagtatcaagtctgggctgttggtggaggttgtactgtggtaccagctgcattgtggatgtggaaatcttccttccagtacatagcttcttgctggaaccatgatggggaccctgtggagctcttgaagttgggaaatcagttagctaaattcagacagtgcctgcaggaaaatccaaaatttttgcaagaaaaagtaaaacagtattttaagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtctagaattacggagtcaacaaagcaaacctcaagatgcctcttgtctgccagcgttgaaagtttccgatattgaacccaccatacctgtcacagagttggacgtggtcctgacagctggagatatccctgttcagtactgcgcccagcccaccaatggcatggtgtatttccgggccttctccagcctgaacacactccccgaggagctgaggccctatgtgcccctcttctgcagcgtcctcaccaagctgggctgcggccttcttgactaccgggagcaggctcagcagatagaattgaagaccggagggatgagtgcttctccccacgtgctccccgacgactcacacatggacacctacgagcagggtgtgcttttctcctctctctgcctggatcgaaacctgccagacatgatgcagctatggagtgaaatatttaacaacccgtgctttgaagaagaggagcacttcaaggtgctggtgaagatgaccgcccaggagctcgccaatggaattcctgactctgggcacctgtacgcatccatcagggcaggccggaccctcacgcccgcaggggacctgcaggagaccttcagcgggatggatcaggtgcggctgatgaagaggattgcagaaatgacagatatcaaacccatcctgaggaagctcccacgtatcaagaaacacttgttaaatggtgataatatgaggtgttcagtgaatgcgactcctcagcagatgcctcagacagaaaaagcggtcgaagacttccttagaagcatcggtcggagtaaaaaggaacggaggcctgtgcgcccacacacggtcgagaaacctgtgcccagcagctctggtggagatgcccacgttccccatggctcccaggtcattaggaagctggtcatggaacccaccttcaagccctggcagatgaagactcacttcctgatgcccttcccggtgaattacgtgggtgaatgcatccgaactgtcccctacacggacccagatcatgccagtcttaaaatccttgcacgtttgatgactgccaaattcttgcatacagaaattcgagaaaaaggcggtgcttatggtggaggcgcaaaactcagccacaatgggattttcaccctttactcttacagggacccaaatacaatagagacgctccagtcttttgggaaggctgtcgactgggctaagtctggaaaattcacacagcaagacatcgacgaagccaaactttctgtcttctcaaccgtagatgctcctgtcgctccttcagacaaaggaatggaccacttcttgtacggcctctcggatgagatgaagcaggcccacagagagcagctctttgctgtcagccacgacaagctcctggccgtgagcgatagatacctcggcactgggaagagcacacacggcctggccatcctcggacccgagaacccgaaaattgccaaggacccatcctggatcatccgatgagcagccgtggcgctcgactgcacaggagcccgagacaatacacctccgagctgaatatgaaaagtcagaaatgctactgctttttccaagaatattatgtcattgagtgtcgccaaagcccttgactggcgagtcaaaaactcagatctatcttaagagtgaccaggaagaggttcattgaaataatcatgcatgaagcgccaaagatgcaccatgtagaattttcactttgtactggcaggctcgttttacctcattctagaatatttaagaatctaaaaataaagggcaactctg

SEQ ID NO: 1555 - DNA, 7444 bp, Homo sapiens
gctggctgcggaaggggagggggggggagaaggcgattggatgcggcggcggcggcggatcccggagagccccggagtgagcggagtagcgagtcggcaacccggaggggtagaaatatttctgtcatggctcattcaaagactaggaccaatgatggaaaaattacatatccgcctggggtcaaggaaatatcagataaaatatctaaagaggagatggtgagacgattaaagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctgataaactaaaggatatatttatgtttataacaagacagttgaaggggctagaggatacaaagagcccacaattcaataggtatttttatttacttgagaacattgcttgggtcaagtcatataacatatgctttgagttagaagatagcaatgaaattttcacccagctatacagaaccttattttcagttataaacaatggccacaatcagaaagtccatatgcacatggtagaccttatgagctctattatttgtgaaggtgatacagtgtctcaggagcttttggatacggttttagtaaatctggtacctgctcataagaatttaaacaagcaagcatatgatttggcaaaggctttactgaagaggacagctcaagctattgagccatatattaccaatttttttaatcaggttctgatgcttgggaaaacatctatcagcgatttgtcagagcatgtctttgacttaattttggagctctacaatattgatagtcatttgctgctctctgttttaccccagcttgaatttaaattaaagagcaatgataatgaggagcgcctacaagttgttaaactactggcaaaaatgtttggggcaaaggattcagaattggcttctcaaaacaagccactttggcagtgctacttgggcaggtttaatgatatccatgtaccaatccgcctggaatgtgtgaaatttgctagccattgtctcatgaaccatcctgatttagcaaaagacttaacagagtatcttaaagtgaggtcacatgaccctgaggaagctattagacatgatgttattgtgtcaatagttacagctgctaaaaaggatattcttctggtcaatgatcacttacttaattttgtgagagagagaacattagacaaacgatggagagtacgcaaagaagccatgatgggacttgcccaaatttataagaaatatgctttacagtcagcagctggaaaagatgctgcaaaacagatagcatggatcaaagacaaattgctacatatatattatcaaaatagtattgatgatcgactacttgttgaacggatctttgctcaatacatggttcctcacaatttagaaactacagaacggatgaaatgcttatattacttgtatgccacactggatttaaatgctgtgaaagcattgaatgaaatgtggaaatgtcaaaatctgctccgacatcaagtaaaggatttgcttgacttgattaagcaacccaaaacagatgccagtgtcaaggccatattttcaaaagtgatggttattacaagaaatttacctgatcctggtaaggctcaggatttcatgaagaaattcacacaggtgttagaagatgatgagaaaataagaaagcagttagaagtacttgttagtccaacatgctcctgcaagcaggctgaaggttgtgtgcgtgaaataactaagaagttgggcaaccccaaacagcctacaaatcctttcctggaaatgatcaagtttctcttggagaggatagcacctgtgcacatagataccgaatctatcagtgctcttattaaacaagtgaacaaatcaatagatggaacagcagatgatgaagatgagggtgttccaactgatcaagccatcagagcaggtcttgaactgcttaaggtactctcatttacacatcccatctcatttcattctgctgaaacatttgaatcattactggcttgtctgaaaatggatgatgaaaaagtagcagaagctgcactacaaattttcaaaaacacaggaagcaaaattgaagaggattttccacacatcagatcagccttgcttcctgttttacatcacaaatctaaaaaaggacccccccgtcaagccaaatatgccattcattgtatccatgcgatattttctagtaaagagacccagtttgcacagatatttgagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcggcttccagggaaaaagacaactaaactttgggttccagatgaagaagtatctcctgagacaatggtcaaaattcaggctattaaaatgatggttcgatggctacttggaatgaaaaataatcacagtaaatcaggaacttctaccttaagattgctaacaacaatattgcatagtgatggagacttgacagaacaggggaaaattagtaaaccagatatgtcacgtctgagacttgctgctgggagtgctattgtgaagctggcacaagaaccctgttaccatgaaatcatcacattagaacaatatcagctatgtgcattagctatcaacgatgaatgctatcaagtaagacaagtgtttgcccagaaacttcacaaaggcctttcccgtttacggcttccacttgagtatatggcaatctgtgccctttgtgcaaaagatcctgtaaaggagagaagagctcatgctaggcaatgtttggtgaaaaatataaatgtaaggcgggagtatctgaagcagcatgcagctgttagtgaaaaattattgtctcttctaccagagtatgttgttccatatacaattcaccttttggcacatgacccagattatgtcaaagtacaggatattgaacaacttaaagatgttaaagaatgtctttggtttgttctggaaatattaatggctaaaaatgaaaataacagtcacgcttttatcagaaagatggtagaaaatattaaacaaacaaaagatgcccaaggaccagatgatgcaaaaatgaatgaaaaactgtacactgtgtgtgatgttgccatgaatatcatcatgtcaaagagtactacatacagtttggaatctcctaaagacccggtactaccagctcgtttcttcactcaacctgacaagaatttcagtaacaccaaaaattatctgcctcctgaaatgaaatcatttttcactcctggaaaacctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggcttgatagttctgaaatggatcacagtgaaaatgaagattacacaatgtcttcacctttgccggggaaaaaaagtgacaagagagacgactctgatcttgtaaggtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagagagcagaatctcctgaatctagtgcaattgaatccacacagtccacaccacagaaaggacgaggaagaccatcaaaaacgccatcaccatcacaaccaaaaaaaaatgtccgtgtaggacgctccaaacaagcagctactaaggaaaatgattcaagtgaagaagtagatgtgtttcagggtagctctcctgtcgatgatattccacaggaagaaacagaggaggaggaagtttctacagtaaatgtacggcggcgaagtgctaaaagggaacggcgatgaacaaatgtaattaataactttctctgtgaaagctttggaaaaatcttttttttttttttttttttttggtcaagcttgaggctgaataaagcctttgatgcacaaaatgggactgctgaagagtggacagttggaccttactttggtgaccccatacatttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatcccattttatcatcctttcagtttttattaatctactgtatcaataaaattctgtaatttgaatgagtttttaatagtctagaatgttattgtgtatagatatttcctcttgaacgttatgttcagaaaatgcaaattacactataatataaaacctgatatatacacattagaaatattccagttctccgtaacagtgtaaagttaatcagaaagaaaaaattttattgatgcagtgtgtctttataaagctgttcttgaaagccaagtgttttgtattttatagtgagttgcatgtttttgaaaaaaagtgctgaaaatgggatgtgctgttttctgtaaattcatatttagccatagtatatgatagattgccccataacatagtttttcatcaagagtttattattgtactttattttggagccaaaaaattgattctggggggtgggggcagcgtagaagtggtatatccaagtatatcagctactgtagttgtcacagtcttgtgaactttgaatgaaattccactttgtccagattgggagaagtggaaatttatttggatttagagcaggtctttttttttcttcattgtaatctgcaaaatgtagaaataaattacttaaggcagtatcctttatacagttgtataaactgtattttgaaccaaaacatataggttactacttaatgcttacctaatttcattttagtattttaggtgctgttatgttttttcatggttaacaccagaggggaaaaaatcatattctaacttattaaatttatcacattgaatagtggaacattttcatatgatacaccattatgtttaagatatatttccaagattggttataatagatggggcatataataaagaagctactattttggaaaatgacattttactatttgccaatgtatattgcaattgatgtgattatttttcttttaaagatttgtttgtgtttatgaaacagccatttattttttaaaaagtgttttgaattgtgtcttaatctctccatattcaactattcttcatttacaacaatagtgacaccagtaattatgagaggctgtcatatatcaaagcagctcaggtgggatcaacatacattggttttgaaatgtttccttagctcggttctcccaaacacataatttctgtttcagcagtacaaaggcatgttttaaaatctataacataaagaataaggaatagctttgtatttttgtcattgattaaattgcaccagaaatgtttatggaaatattaagaacattttataaaacatacgaaaaagtgattgtgaaggatttttatttgcatgattatagttaagcaaatttcatttcacatttttgtaatgctgtacagcagttcacaaaaaaatgttcattgtagattttgttatgttcaatgccaatgagtctgtaattttacgacctgtctgttctttttttgggtggattacgatgtaaatttttcttttctttctttctttttttttttttttgtgtagaaaaataggtgcaataatgatcaaagttttgatgtcttgagtctccatcttaggggattatcttacgtttaagcttaacatttcatgtagtaagatttggagagccacatactttacagtaaaattaagtgtgtataaaacattaattgctaacaattgttagcaaactatttcagtgataatgttcattttgaaaatatgtactgtataacattaagaaaatatttaactccctgtaacaagttccattatgaaaatcttattcctcagtgaggttatcttgctgcactctgtagcaaatttgtttaatctacattataataaaatttcttgctgcagtgcaacaggaggctttttcagtgatcttcactgtatatgtaaattacaaatgtggctgtaaaacttattccaggtattaaaggttaaattgctttctatatcttcttataacttgtaagtctgatttttaagatttccttttgtccacttgtaagaatgtcaggaatttaagaatttgtttaaattaggcatatctctgccatcacatagtattatgtcaccataatgaacaattgctatttaaatagataaccaattttcagacacatttttggatttctgtgaagttgaataaacataaaagctaa

SEQ ID NO: 1556 - DNA, 4220 bp, Homo sapiens
acgttgcccgggatgcggacaggttccgccgcctccagcgccccatcctgagccgattatctgcaattatgaaatgaagtaactcaagatgagcaagttaaaagtgataccagaaaaaagccttaccaataattctaggatcgtaggactcctggctcaactggagaagatcaatgctgagccttcagaatcagacactgcccgatatgttacatcaaaaattcttcatctggctcagagtcaagaaaaaacaaggagagaaatgacagccaaaggttctacaggaatggaaattctgctgtcaacattagagaacacaaaagatcttcaaactacacttaatatcttaagcattcttgttgagctggtgtcagctggtggaggtcgaagagtgagtttcttagtcaccaaaggtggttcacaaatattgttgcagttacttatgaatgccagcaaagaatctcccccacatgaggacttaatggtacagattcattctattcttgcaaagattggaccaaaagataaaaaatttggagtaaaggctagaattaatggggctctgaatataaccctgaatttggtcaagcagaatttgcagaatcatcgcttggttctaccttgccttcagcttttacgagtatattctgccaactctgtgaattcagtatccttagggaaaaatggagttgtggaactgatgtttaaaatcattggaccatttagtaagaagaattccagtcttataaaggttgctttagacactcttgctgcattgctaaaatcaaaaacaaatgccaggagagctgtagacagaggatatgtccaagtgcttttaacaatttatgtagattggcaccgccatgataaccggcatagaaacatgctcattcggaaaggaattttacggagtttaaaaagtgttacaaacatcaagttgggaagaaaagcatttattgatgccaatgggatgaaaattctgtataatacttcgcaattgcctgttattcctgtgactggtcctgtggctcagctctacagcttacctcctgaagtggatgacgtagtagatgaaagtgatgacaacgatgatattgatgtagaagctgaaaacgaaactgagaatgaagatgacctagatcaaaattttaagaatgatgatattgaaacagatattaacaaactaaaaccccagcaagaaccgggacgaacaatagaagatctaaaaatgtatgaacaccttttccctgagcttgttgatgattttcaggactatgatttaatctccaaagaaccaaagccttttgtatttgagggaaaagtacgtggtcctattgttgttcctacggcaggcgagggaacatctgggaattctggcaatttaagaaaagttgtaatgaaggagaacatatcttctaaaggagatgaaggtgaaaagaagtctacctttatggatctagcaaaagaagatattaaagataatgatagaacattacaacagcagccaggtgatcaaaatagaactatttcatcagtccatggtttaaacaatgatattgtaaaggccttggaccgaattacattgcagaatattccttctcaaacagccccaggttttactgcagaaatgaagaaggactgcagtcttcctcttactgtccttacctgtgctaaagcatgtccacacatggctacttgtggaaatgttctgtttgagggaagaacagttcagctagggaagctttgctgcactggagttggaactgaagatgatgaagatactgagtcaaattcatcggtagaacaagcatcggttgaagtacctgatggaccaacactccatgacccagacctctatattgagattgtgaaaaatacgaagtctgtcccagaatattcagaggtggcttatcccgattattttggtcacattccgcctccattcaaagagcctattttagaaaggccttatggtgtacaaaggacaaaaattgctcaagatattgaaaggctaatacatcagagtgatatcatagatcgtgtggtatatgacttggataacccaaattacaccattccagaagagggagatattttgaaatttaactccaaatttgagtctgggaatctgcgcaaagtaattcaaattagaaaaaatgaatatgatcttattctgaactcagacataaacagcaatcattatcatcagtggttttactttgaagtcagtggaatgcgaccaggtgttgcttacaggtttaacatcattaactgtgaaaagtccaacagtcagtttaattatggtatgcaaccactcatgtattcggttcaggaagcattaaatgccagaccatggtggattcgtatggggactgacatttgttactataaaaatcatttctcaagaagttcagttgctgcaggtgggcaaaagggaaaatcctactatacaattacatttactgtcaattttccacataaagatgatgtttgctactttgcttatcactatccatatacgtattcaactttacagatgcatcttcaaaaattggaatcagcacacaatcctcagcaaatctattttcggaaagatgtgttatgtgaaaccctgtctggaaacagctgccccttggtgactataacagcaatgccagagtctaattattatgaacatatctgccatttcagaaatcgcccttacgttttcttgtctgctcgggtacatcctggagaaactaatgcaagttgggttatgaaaggaacgttggaatatctcatgagcaataaccccactgctcagagcttacgagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaagaatccacagcacgtgttgtagtttggagggaaataggagtacaaagaagttataccatggagagtactttatgtggctgtgatcagggaaaatacaagggtttacagattggtacccgagaactggaagagatgggagcaaaattttgtgttggtcttttacgtttgaaaagactgacctctccattggagtataatctgccttccagcctgcttgactttgaaaatgatttaattgaatcaagctgcaaagtaactagccctaccacttatgtcttggatgaagatgaacctcgattccttgaagaagttgattacagtgcagaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcttgagagaaatgagtttatacagagctgactcaaaaagacaaaaagtaacttgggccagtttggtttcaagataataaatgtgttattaattaatgataaaattggcgcttgttttattttcgatattcaatgcactttatgtagcattgaatgatcaaatattggatttacctttaaaaaaaaaaaacctgagtatcattgcatgaatttttatctccctatggttatatcctgcatcaagtggataattttgaagtgtgttcagaatataaaattgaaattttagagttgttgaaaatcctgacttgttgaaaactaatatatatgtacatggatttctatagatgtgtttgtttagaagtgggtagatattgcagataagactgttcttcagaatcatgttaactattgggttgtgactgaagtagtgcagggtttgccttgaaaccattacattctacatttaccaaattaaacaaataaaaactgtattaaatgttgc

SEQ ID NO: 1557 - DNA, 3689 bp, Homo sapiens
aagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttaacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaagcatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagcccttactaagccgagaggtgtcattcctgcaggcaggacctataggcacgtgaagatttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatgtcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttaacctgagtttcataggaggtaatcaccagacaactgcagaatgtagaacactgagcaggacaactgacctgtctccttcacatagtccatatcaccacaaatcacacaacaaaaaggagaagagatattttcggttgaaaaaaagtaaaaagata

SEQ ID NO: 1558 - DNA, 1371 bp, Homo sapiens; identical to SEQ ID NO: 191

SEQ ID NO: 1559 - DNA, 1637 bp, Homo sapiens
tgattgcctatctcttcttgaccccaagaccttccttggatttcagaagtgtcaagccttgggatacaatctccgagactcctgctttacattagggactcaaggcgtgagggagcttctaggactgattcccagatagtctctttgatcttccttgtaggtcttcaaagcttcacctttctccaaaggcagatgtgaagaacttgatgtcttatgtggtaaccaagacaaaagcgattaatgggaaataccatcgtttcttgggtcgtcatttcccccgcttctatatcctgtacacaatcttcatgaaagaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacctgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacttgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttgatggaaaaaaaaaaaaaaaaa

SEQ ID NO: 1560 - DNA, 1781 bp, Homo sapiens
gggccgctcccagctgggacgtgagtctctggattaggcaggcagaggcagttatgggcttctgcagtggcgagaaaggaagcgcctgaagggtcgtgaggctggggcgggacccggcaccgctggggcggccaggccgtgaggacttcaatggcgagcagcgtggacgaggaggcgctgcaccagctgtacctgtgggtagacaacatccctctgtcccggcccaagcgaaacctctcccgggactttagcgatggagtccttgttgcagaggtcatcaagttttacttccccaagatggtggagatgcacaattatgtccccgccaactctctccagcagaagctcagcaactggggtcatctgaacaggaaggtactgaagaggctgaacttttcagtaccggatgacgtgatgcgcaagatcgcgcagtgcgccccaggcgtggtggagctggtgctcatcccgctgaggcagcgcctggaggagaggcagaggcgcaggaagcagggcgccggctccttacaggagctggctccccaggatggcagtggctacatggatgtgggtaaggtggccttttccatttctccctcccggttggagctttccttctgtccttcttcctgtcacttgtaagagtggaagtagggagggggaagcaggagaatgagactccagcacagtcattcctccacttgccttgtctcaggtgtatcccagaaggcccgaggtgaaggtgtcccggacccccagggagggggtcagctcagctgggaccggccgccggcgcctcggcctccagcgtataaccgggcgttgcagggcgaccccagcttcgtcctccagatcgctgaaaaggagcaggagctgttggcctctcaagagaccgtgcaggtcctgcagatgaaggtaaggcgcctggagcacctgctccagctcaagaatgtgcggatcgaagacctctcccggcggctccagcaggcggagcgtaagcagcggtgagcggcggcccgggccgcgcggggacgcccgggtacccgccagagccccgacgccgcgccggacccacccaccgatggatagaccattgggagggcggagcccgctgctctcacgagcctgctggggcccgagtgccctccttccttgggatgggtgagcgtgggaggagatgggacaggaactctaggagcgcaggcccgggactgagccgcctcctaccactccggagatccgggtcaggagaatggaccgctttccagagcccagaagccacgtgcagagacctagcctgtcccccaaagcagtgtccaacaccttgggcccggccttgcatctcccggcgctgggccttggggggcggtcccttggctctgtccacacccccagaatcaggtccccgcccagctccgaggacggcggcgtctccatccacgctagttccccatgccctcagccatgggggaatctgtcccgggccgctgaggggctcccctgcccctcctgggagcttacctgggacccacctcggcgacggagaccgcagcagctggagaggaaggggtgaggcgtgggatcgccaggagtagggaggacatcgacgatgtgcccgtagcagtcgcccctccctcctcgcgcacggggtactgaggcggaaggtttgaaggttacggctcagggctgccccattaaagtcagtgttgtgttctaaaaaaaaaaaaaaaaaaaaaaaaaaaaaaaaaaaaaaaaaaaaaaaaaaaaaaaaaaaaaaaaaaaaa

SEQ ID NO: 1561 - DNA, 1338 bp, Homo sapiens
atgaaggtgaagatgctgagccggaatccggacaattatgtccgcgaaaccaagttggacttacagagagttccaagaaactatgatcctgctttacatccttttgaggtcccacgagaatatgtaagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagaggttagaatttggaatctaactcagcggaattgtatccgtacaatacaagcacatgaaggctttgtacgaggaatatgtactcgcttttgtgggacttcttttttcactgttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagattataacttatatacttttgatatgcgtgcactggacactcctgtaatggtccatatggatcatgtatctgcagtgcttgatgtggattactctcccactgggaaggagtttgtgtctgctagtttcgataaatctattcgaatctttcctgtagacaaaagtcgaagcagggaggtatatcatacaaagagaatgcaacatgttatctgtgtaaaatggacttctgacagcaagtatattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataa

SEQ ID NO: 1562 - DNA, 3463 bp, Homo sapiens
agcgcgcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgg

SEQ ID NO: 1563 - DNA, 2283 bp, Homo sapiens
cccacgcgtccgcccacgcgtccgagcctgcgcaggaggccaataggctgccaatactccttggactccccgccagggccctgctgtcagtgcgcctgcgcgcgggtccggcgccgaggttcttgactgctgtgccggacgccaggtgtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggggtaagttccttgggggagaggaagaagctgcttagttatatccagcgattggttcaaatccacgttgatacaatgaaggtaattaatgatcctatccatggccacattgagctccatcctctcctcgtccgaatcattgatacacctcaatttcaacgtcttcgatacatcaaacagctgggaggtggttactatgtttttccaggagcttcacacaatcgatttgagcatagtctaggggtggggtatctagcaggatgtctagttcacgcactgggtgaaaaacaaccagagctgcagataagtgaacgagatgttctctgtgttcagattgctggactttgtcatgatctcggtcatgggccattttctcacatgtttgatggacgatttattccacttgctcgcccggaggtgaaatggacgcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattgtggccatataaagggcgtcctgaaaacaaaagcttcctttatgagatagtatctaataaaagaaatggcattgatgtggacaaatgggattattttgccagggactgccatcatcttgggatccaaaataattttgattacaagcgctttattaagtttgcccgtgtctgtgaagtagacaatgagttgcgtatttgtgctagagataaggaagttggaaatctgtatgacatgttccacactcgcaactctttacaccgtagagcttatcaacacaaagttggcaacattattgatacaatgattacagatgctttcctcaaagcaggtgactacatagagattacaggtgctggaggaaaaaagtatcgcatttctacagcaattgacgacatggaagcctatactaagctgacagataacatttttctggagattttatactctactgatcccaaattgaaagacgcacgagagattttaaaacaaattgaataccgtaatctattcaagtatgtgggtgagacgcagccaacaggacaaataaagattaaaagggaggactatgaatctcttccaaaagaggttgccagtgctaaacccaaagtattgctagacgtgaaactggaggctgaagattttatagtggatgttatcaacatggattatggaatgcaagaaaagaatccaattgatcatgttagcttctattgtaagactgcccccaacagagcaatcaggattactaaaaaccaggtttcacaacttctgccagagaaatttgcagagcagctgattcgagtatattgtaagaaggtggacagaaagagtttgtatgccgcaagacaatattttgttcagtggtgtgcagacagaaatttcaccaagccgcaggatggcgatgttatagccccactcataacgcctcaaaaaaaggaatggaacgacagtacttcagtccaaaatccaactcgcctccgagaagcatccaaaagcagagtccagctttttaaagatgacccaatgtgaatgtctgtagtcagttgtttacaaactccctctcctgcacaattcatttagaggcttcaatcatagaattctgcaaattaatgacaactcatgccttaattttgtattttgaatgtacacgcatgctgaagctaagtaacttttaatcaaagaaataagatggtattaggcaaatcttactatactatgaaaagcattaccttgcctatttttaatattattaaagcctttctccttcgaaaaaaaaaa

SEQ ID NO: 1564 - DNA, 1943 bp, Homo sapiens
ggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatccctcacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaaaaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttaaagagacagggctttgctgaaaaccaaacatgggccagctgggctttttaacaacctagagactttccggagctgcctggaacagagcctgtgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagctctgtgcctgtgtgtccagccctggagccagccagtgcatttattttaagctcttagaagcaactccttggcccaggaatgcgtgacccctgagatgggtccacgcatctctctacacgtccttctctccgtgggatactggactcgtgcctctgcgcccattctcttctcacgcatatccatgagctttaatttcactttctgatcacggtacgtccataaagccagtattacacttaaatgaagtattcttttttgtaatcgtttttttttagaaggtaaaaaaatttaataaagctaccaataatgttgaaaaaaaaaa

SEQ ID NO: 1565 - DNA, 2398 bp, Homo sapiens
ccgcagaggagcctcggccaggctagccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatcaaaaaaaaaaaaaaaaa

SEQ ID NO: 1566 - DNA, 2331 bp, Homo sapiens
tggcagcgacgcggtgaggagacggcccacggcgcccgcgggctggggcggtcgcttcttccttctccgtggcctacgagggtctggatccttccctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctgtgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcagggggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctgcaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatctagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaaaaaaaaaaaaaaaaaa

SEQ ID NO: 1567 - DNA, 1619 bp, Homo sapiens
agttctgcggtgccagggagtggagcagagctcagccccgtcccaaacacagatgggaccatgaactccggacacagcttcagccagaccccctcggcctccttccatggcgccggaggtggctggggccggcccaggagcttccccagggctcccaccgtccatggcggtgcggggggagcccgcatctccctgtccttcaccacgcggagctgcccaccccctggagggtcttggggttctggaagaagcagccccctactaggcggaaatgggaaggccaccatgcagaatctcaacgaccgcctggcctcctacctggagaaggttcgcgccctggaggaggccaacatgaagctggaaagccgcatcctgaaatggcaccagcagagagatcctggcagtaagaaagattattcccagtatgaggaaaacatcacacacctgcaggagcagatagtggatggtaagatgaccaatgctcagattattcttctcattgacaatgccaggatggcagtggatgacttcaacctcaagtatgaaaatgaacactcctttaagaaagacttggaaattgaagtcgagggcctccgaaggaccttagacaacctgaccattgtcacaacagacctagaacaggaggtggaaggaatgaggaaagagctcattctcatgaaggagcaccatgagcaggaaatggaggagcatcatgtgccaagtgacttcaatgtcaatgtgaaggtggatacaggtcccagggaagatctgattaaggtcctggaggatatgagacaagaatatgagcttataataaagaagaagcatcgagacttggacacttggtataaagaacagtctgcagccatgtcccaggaggcagccagtccagccactgtgcagagcagacaaggtgacatccacgaactgaagcgcacattccaggccctggagattgacctgcaggcacagtacagcacgaaatctgctttggaaaacatgttatccgagacccagtctcggtactcctgcaagctccaggacatgcaagagatcatctcccactatgaggaggaactgacgcagctacgccacgaactggagcggcagaacaatgaataccaagtgctgctgggcatcaaaacccacctggagaaggaaatcaccacgtaccgacggctcctggagggagagagtgaagggacacgggaagaatcaaagtcgagcatgaaagtgtctgcaactccaaagatcaaggccataacccaggagaccatcaacggaagattagttctttgtcaagtgaatgaaatccaaaagcacgcatgagaccaatgaaagtttccgcctgttgtaaagtctattttcccccaaggaaagtccttgcacagacaccagtgagtgagttctaaaagatacccttggaattatcagactcagaaacttttatttttttttttctgtaacagtctcaccagacttctcataatgctcttaatatattgcacttttctaatcaaagtgcgagtttatgagggtaaagctctactttcctactgcagccttcagattctcatcattttgcatctattttgtagccaataaaactccgcactagc

SEQ ID NO: 1568 - DNA, 1113 bp, Homo sapiens
ggggcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaggtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcaaaaaaaaaaaaaaaaaaaaa

SEQ ID NO: 1569 - DNA, 2381 bp, Homo sapiens
ttttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccaagaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgtaaaaaaaaaaaaaaaaaaaaaaagaaaaaaaaaaaaaaaaa

SEQ ID NO: 1570 - DNA, 1560 bp, Homo sapiens
ggcaggcccgcgcccgcgcccggactttgccatcggcggggcagtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtcctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactccgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcgtttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccacggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttccctaaaaaaaaaaaaaaaaaaaa

SEQ ID NO: 1571 - DNA, 2013 bp, Homo sapiens
ctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaaaaaaaaaaaaaaaaaaaaa

SEQ ID NO: 1572 - DNA, 3306 bp, Homo sapiens
tggcctcttggagcgagtcagccaggcctcctcctatcccgacgtgaaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgttttcttctagaaactttagaaagagtgcgatgcccctttgcctttgcatccttagccagtgtcacccacacagccagccgcagcgcattctcatgctgtggcccctccccagaccgccagcgccctgcagccaccaggtctgcagtgtgcattaggattattgctggtcttcctagggggtaaaaggatcagagagagaagaattaagtgctaaattggaagaaaaccccaatatagttatgtaaaatgtcactacattgattttccaagaggcattgtaggaacatgtcaaaaacagccagccctttaaatattgcagtcagccaaggaaattagatgagaattgtggctattaagagaattcactgagagttattctctagatttttagccgacaattaaccactaaaagctactgcttttccagggtgggggagggaatgaatacatagaaaaacaaaaaagattgttctggattctcagtgaaaggctataggaagtctgttctggagacatctactttttagatcctgatacatcactgagtgtcatactccactaaaaggaaactctaaccgaaggctggctggtgtgacaatcccgttagttggatcttcacctacagccagattttgctctagtggccctcttcctgtaaacccagatggcgtcatacagaaattgtttctttcagaagcagattggaatctcttgggaccatgagactgagtcccaatatttccacccagggtcatgcccgttgttgtctacttccattttgagatctatagtttgattatctattattacaggaactgtttcttttctttttctaggagtgtttatgagagtgtgatattttaaagtcagacgcagcaaaaactgtttcagggtgaagaaagacccctttcagccctgttttgcagccctgggtgggggcatgagatagacagcaagcttctgatcttgaagcttgtctagaagacacatcttctaggtctcgtggtcatttggtaggctgacctttgagtgagcgaggccactattgagtggatagcaagaacattggaaccagagcctcggcacaggcctggcactggctgtacatcagctcttacaactaaacaactcaactaagcaactgaaacgaaacaaaggagcattcgttctctgttgttaggaatcattctgctctgttagggaagggctgcaggaagggcagtttcctgaataaaaatctggctgcgaccagtcccatgtgtctggtaagtaagtaagtaagtaagtgccctttgaagggatcattaagacacagggagcatgaacctgagatcagaagcatttctttactaatttagattctgcgaaatagacggacctctccacccccaaacctaaaacaggccaggacttgtctctgtgctgaaagcaaatagcaagactaactcaagccccagcctctttccacactccctgatacctaaggactgctttctcagctagaccagggtgggcatcagcgacgccttctcagctagaccagggtaggcatcagcgtcctctctccatctctatacccctctctctcacatcaggaagatgaaatgtgtagctctagcggcaacctctagccaggagcccagtggcctctcagattgctttttggccaggtctcagcactgctggcatctttacatcttactccttaaaaccgcctctcgctgaggagccactgcattttgaagaatttctcagtgtctgtcaggaaagtactcctgctcatttggaacgccacacaccacccgcactcacctgtccaggcgaatgagcaggtcctgtagctttacaaatatgccgctgatgccgcttctccccagggtctctcagttttccaggacaaaaagatttagggcctataccctatgggcaaaacacctaaaatgtcaacagtcaaaatgccattctttttggccatcataagagggagtaggtatcactgctgcatgccagttgtttttgactagaatatgccaaccagagcttgttggggcaggagacgtttttccttacaagcagactgcctgtgccctgtgccctgtttgctacttcactgccatggaatgatccgagtactgtatctcagagctgccccttccccagcagcaaacactcgctgagtccacgtctggcttcaggtgggaggaaatgtttcagatgaaacttactcaattcataccaccctgaaatggaggacagaggtgacaaacttcagtttaataggtttctcaccaagttgtatgttccattggcccaggattcttgcactaatgggtttctatcacattatgtctataaatgggtgcactttactgtttgaatttgtaactgaagtactggatatttaagtgtgagtaatgtcttcattagaaaatagcagaaccgctcttgtcttttagtgtatttttcaagaaagaaaaggagaaggaagaggaagaagaaggagaaagaagaagaagaagaagaactaagaagaactaagaagaaggagaagaagagggagagaagaaagaagaaaaggagaaggaagaagaagaactaagaagaaggaggaagaaagaaggagaaggaagaagagagaaggagaaggaagaaggagaggagaagaaggaagaaggagaaggaagaggaggaagaactaaagaaggagaaggaagaggaagaaggaaaaaaaaaaaaaaaa

SEQ ID NO: 1573 - DNA, 2201 bp, Homo sapiens
gggggtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggacttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcattttgggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactaatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataaaaaaaaaaaaaaaaaa

SEQ ID NO: 1574 - DNA, 2714 bp, Homo sapiens
gagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaagggcgctacgtttattgcctcgtcttattcactgacctttgtaatgatacacagtgaattctttttgacaaagagaaatgcagtgtagtatgcagagctgctgttttaatgccctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttattttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatgttttcatggctaggtatttctaatgtttattcttccctgtgtacttctacacatagctatgcactatgaaaattaaatggaatgaatgatatgtatattactcaaaataaagtttctttcactttaaaaaaaaaaaaaaaaaaaa

SEQ ID NO: 1575 - DNA, 3809 bp, Homo sapiens
attcgaaagaaaaatccaacttatgaattgtcattaatgcaaaattatttatcagaaaatcgtagagcactggaaccccatcatttcacagatgagaagaccagaagcaaaatgacctgccagagttgcagactgacaactgctgccttggcctagtcaagcccagacaggcatctcctactgccttaatttgggggcatctttctaggaccctgatctgcctccacatcttgaaggattttcaagatagccatgtttcacaaaggaacgagggcagctgtgtttagagtggtcaaatttctgattctgtttttttgcttaggaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggagattccagaagcttatttcattagagacccccacactttccttcttacaaaggactttattaaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaaaaaaaaaaaaaaaaaaaa

SEQ ID NO: 1576 - DNA, 3472 bp, Homo sapiens
tggcggccgccggcgtcgccgccatggacctaggacccttgaacatctgtgaagaaatgactattctgcatggaggcttcttgctggccgagcagctgttccaccctaaggcactggcagaattaacaaagtctgactgggaacgtgttggacggcccatcgtggaggccttaagggagatctcctcggctgcagcacactcccagccctttgcctggaagaagaaagccctgatcatcatctgggccaaggttctgcagccgcaccccgtgaccccgtccgacacagagacacggtggcaggaagacctgttcttctcggtgggcaacatgatccccaccatcaaccacaccatcctcttcgagctgctcaaatccctggaagcttctggactctttatccagctcctgatggccctgcccaccaccatctgccatgcagaactagagcgctttctggaacatgtgaccgttgacacttctgccgaagacgtggccttcttcctggacatctggtgggaggtgatgaagcacaagggtcacccgcaggaccccctgctctcccagtttagtgcaatggcccataagtacctgcctgccttagatgagttcccccatcctccaaagaggcttaggtcagacccagacgcgtgccccaccatgcccctgttggccatgctgctccgcgggctgacacagatccagagtcggatcctgggcccggggaggaagtgctgtgcgctggccaacctggctgacatgctgactgtgtttgcgctgacagaggacgacccccaggaggtgtctgcaaccgtgtatctggacaaactggccacggtgatctctgtgtggaactcggacacccagaatccctaccaccagcaggcgctggcagagaaggtgaaggaggcagaacgggatgtcagcctgacctcgctggccaaactccccagtgagaccattttcgtgggctgcgagttcctgcaccacctgctgcgggagtggggggaggagttgcaggccgtgctccgcagcagccaggggacaagttacgacagctaccggctgtgcgacagtctgacttccttcagccagaacgcgacgctctacctgaaccgcaccagcctgtccaaggaggacaggcaggtggtctctgagctggcggagtgtgtcagggacttcctgaggaaaacgagcacggtgctgaagaacagggccttggaggatatcacagcttccattgccatggccgtcatccagcagaagatggaccgccatatggaagtgtgctacatttttgcctctgagaagaagtgggccttctcggacgagtgggtagcctgcctggggagtaacagggccctcttccgagagccagacttggtgttgaggctgctggaaacagtgatagacgtcagcacagctgacagagccatccctgagtctcagatccggcaggtgatccacctgatcctggaatgttacgcagacctctccctgccaggtaaaaataaagtccttgcaggtatcctgcgttcctgggggcgaaagggcctctctgaaaagttgctggcttatgtggagggttttcaggaagacctcaatacaacttttaaccagctcactcagagtgcctccgaacagggcttggcaaaagctgtggcctccgtggcccgcctggtcatagtgcacccggaagtcacggtgaagaaaatgtgcagcctggctgtggtcaatctcggcacccacaagttcctggcccagattctcactgccttccctgcccttaggtttgtggaagtgcagggtcccaattcatctgccactttcatggtgtcatgcctcaaagaaaccgtctggatgaagttctctacacccaaggaagaaaagcaatttttagagctcctgaactgcctgatgagtcccgtgaaaccccaagggattccagtggctgctcttcttgagccagacgaggtgctgaaggaatttgtcctgcctttcttgaggttagatgttgaagaggtagacctcagtctgaggatcttcatccagactctagaggcaaacgcgtgccgagaggaatactggctccagacctgctccccgtttccactcctcttcagcttgtgccagctcttggaccgctttagcaaatactggccgcttcccaaggagaagcggtgcctctctttggataggaaggatctagcgatccatatcctggagctcctgtgtgagattgtatcagccaatgctgagaccttctccccggatgtctggatcaagtccctgtcctggctccaccgcaagttagaacagctagactggactgtgggcctgaggctgaagagcttcttcgaggggcacttcaagtgtgaagtgccagccacactttttgagatctgtaagctttcagaagacgagtggacctcccaggcccacccagggtacggggctggcacggggctcctggcctggatggagtgctgctgcgtctccagcggcatctcggagaggatgctgtctctcttggtggtggacgtgggcaatcctgaggaggtcagactgttcagcaaaggctttctggtggccctggtgcaagtcatgccttggtgcagccctcaggagtggcagcgccttcaccagctgaccaggagactgctggagaagcagctcctccatgtcccttatagcctggaatatattcagtttgttcccctgctcaacctgaagccctttgcccaggagttgcaactctccgtcctcttcctgaggactttccagtttctctgcagccatagctgtcgtaattggcttcctctggaaggctggaaccacgtggtcaaactcctctgtggcagtctgacccgcctcctggactcagtcagggcgatacaggcagctggcccttgggttcaaggaccagagcaggacctgacccaggaagccctgtttgtttacacccaggtgttctgccatgctctgcacatcatggccatgctccacccggaggtctgtgagccactctacgttttagccttggaaaccctcacctgctatgagactttgagcaagaccaacccttctgtcagctccttgctccagagggcacacgagcagcgcttcttaaagtccattgctgagggcattggccctgaagaacggcgccaaaccctgttgcagaagatgagcagcttctgacttggcgtggggagctgggccccaacatggcgggtctgcagaagatcagcagcttcttacctgtgcgggagcgaaaaagctgggcttcaacatggcaggtctgtaggggtcagacccgagcagcctggactttacagttatgtgaaactgtccacaaaaagtcatggcaataatggtgtaaagaaaatagtttcttgggtatttgtaacgtacaaactatcataaaaattctcctctttcgcatctcaaaaaaaaaaaaaaaaaaaaaaaaa

SEQ ID NO: 1577 - DNA, 2452 bp, Homo sapiens
  Modified_base 234, 235, 275, 276, 304, 296, 864, 974, 1096, 1097, 1098, 1187, 1270,1284, 1434, 1435, 1721, 1728, 1877, 1891, 1892, 1893: n = a,c,g, or t
ctcttctctctttttttctttattagtcttgctagcggtctatcaattttgttgatcctttcaaaaaaccagatcctggattcattaattttttgacgggatttttgtgtctctatttccttcagttctgctctgattttagttatttcttgccttctgctagcttttgaatgtgtttgctcttgcttttctagttcttttaattgtgatgttagggtgtcagttttggatctnncctgcttctcttgtgggcattagtgctatagttcctctanncgcttgaatgtgtccagagattctgggnatgttgtgtctttgttctcgttggtttcggaaattccctatcacaagtagaccaacacagacacgaaggttggaaataataccatccatgtncaccgagaaattcacaagataaccaacaaccagactggacaaatggtcttttcagagacagtatcacatctgtgggagagcaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtnccagtggcctcctctgccagccccacagccacagcctggtgtatgtgtgcaagccgaccttcgtggggagccgtgaccaagatggggagatcctgctgcccagagaggtncccgatgagtataagttggcagcttcatggaggaggtgcgccaggagctggaggacctggagaggagcctgactgaagagatggcgctgggggagcctgcggctgccgccgtgcactgctgnnnggaagagatttagatctggaccaggctgtgggtagatgtgcaatagaaatagctaatttatttccccaggtgtgtgctttaggcgtggnctgaccaggcttcttcctacatcttcttcccagtaagtttcccctctggcttgacagcatgaggtgttgtgcatttgttcagcncccccaggctgtnctccaggcttcacagtctggtgcttgggagagtcaggcagggttaaactgcaggagcagtttgccacccctgtccagattattggctgctttgcctctaccagttggcagacagccgtttgttctacatggctttgataattgttgaggnnaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctcagcacagcctggngagggngtcattgttctcctcgtccatcagggatctcagaggctcagagactcgaagctgcttgcccaagtcacacagctagtgaagaccagacgagtttcatctggttgtgactctaagctcagtgctctctcactaggggaacagccttggtnccaccaaaagtgcnnnccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtcctctttggcagttgcattagtaactttgaaaggtatatgactgagcgtacgatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacagatgatgttttcaggtgtcatggactgttgccaccatgtattcatccagagttcttaaggtttaaagttgcacatgattgtataagcatgctttctttgagttttaaattatgtataaacataagttgcatttagaaatcaagcataaatcac

SEQ ID NO: 1578 - DNA, 4382 bp, Homo sapiens
gttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcagaagtgcatatgttttcagtcatccccaacaaattccttccaaacagtaagagcccctgttggtacgaggagttctcggggcagaacaccaccgacccctacctcaccaactcctacgtgctctactccaaagcgcttccgctccaccttcgacgccctgcgcaaggccttctggggcacctggcggcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgaggctccaggttgggctctatgctgtgtaccttctggactggctcagcgtttttgacaagcaacagtttctcattcttcgcctggaagatcatgcatccaacgtcaagtacaccaatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctggggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcacggtatggaaaaccccaggactctgccactctaggcacacatgaattataaccattttggaatttccttcgtgatgttcgagagctcagcaatggacccctcacagagctcctctaatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcatttcagtacatattttactatccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtgacgcctgtggagcgcgtgctcttcctctgcagccaaaaaaaaaaaa

SEQ ID NO: 1579 - DNA, 961 bp, Homo sapiens
tcttctgtgcttcaccatctacataatgaatcccagtatgaagcagaaacaagaagaaatcaaagagaatataaagaatagttctgtcccaagaagaactctgaagatgattcagccttctgcatctggwtctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtagaaaaaaaaaa

SEQ ID NO: 1580 - DNA, 2147 bp, Homo sapiens
ggctcttttaaatgaccccaggcgtcgtgtattgaatcctagactcacgtccgtctcgccggcgcccgagccagtccgcgcgcaccgcgtctgcgtccccgaaagccccgcccgcaagggctgccctgcctacctggtctccgacgtgctcgtctggagggcggtgcgaggggccgagccgacgagatgttcttgctgcctcttccggctgcggggcgagtagtcgtccgacgtctggccgtagtacgttctgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgccgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagttaaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgtgtctggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgcacttgtcagaaacaataaatgcaacttgttgtgaaaaaaaaaaaaaaaaaaaaaaa

SEQ ID NO: 1581 - DNA, 1880 bp, Homo sapiens
atgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgttgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgggaggacctcaggggtggctgagctcttacctggttttcaggcggggcccatagaagactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcaca

SEQ ID NO: 1582 - DNA, 2157 bp, Homo sapiens
gcggctatgccgtctggctctgctcgtcctgttgctcctggggcccggcggctggtgccttgcagaacccccacgcgacacctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgcaacacaaaaa

SEQ ID NO: 1583 - DNA, 1561 bp, Homo sapiens
ggcccgctccaacatcagaatggtaacagctttcaggagcctaccacgcggcagctccggagctgccgcgtccatgtccgcgcacaatcggggcaccgagctcgaccttagctggatctccaaaatacaagtgaatcacccggcagttctgaggcgtgcggaacaaatccaggctcgcagaaccgtgaaaaaggagtggcaggctgcttggctcctgaaagctgttacctttatagatcttactacactttcaggtgatgatacatcttccaacattcaaaggctctgttataaagccaaatacccaatccgggaagatctcttaaaagctttaaatatgcatgataaaggcattactacagccgccgtttgtgtttatcccgcccgggtgtgtgatgctgtaaaagcactcaaggctgcaggctgtaatatccctgtggcatcagtggccgctggatttccagctggacagactcatttgaagacacgattagaagagatcagattggctgtggaagatggagctacagaaatcgacgtggtaattaacagaagcttggtgctgacaggccagtgggaagccctgtatgatgagattcgtcagtttcgcaaggcctgtggggaggctcatcttaaaactatattagcgacaggagaacttggaactcttactaatgtctataaagccagtatgatagcaatgatggcaggatcagattttattaagacctctactggaaaagaaacagtaaatgccaccttcccggtagctatagtaatgctgcgggccattagagatttcttctggaaaactggaaacaagatagggtttaaaccagcaggaggcatccgcagtgcaaaggattcccttgcttggctctctcttgtaaaggaggagcttggagatgagtggctgaagccagaactctttcgaataggtgccagtactctgctctcggacattgagaggcagatttaccatcatgtgactggaagatatgcagcttatcatgatcttccaatgtcttaaatcagtcaccagttccagaaaagttctttacgacaatgtttaaaaattatttttctacgtaattgctaaaattatttaattaaaaaattgggcagtaggtaactggcattcctctctttaaaatttctaccgaacttaatggaatggaaaaagcaaactcatccacatgtggtactcatttcaggcacatctgaaatgatcttaattactagaagatctgcactattaactttgtgaagagtttctcctaaaaactttaagtaaaatgttaatggtagctttgataacatcaaattctaagggagaaaaaaacaatattaaaccgcccaagcagtgtgccctagcagaggaaaatgcaacatctcgcaagcgctgctgtaacgacttcaggagtcactgattcagcactaatttcctgctgtgaaaactcatctttcatttttgccgtggataggcgcttttattaattgttgtcctaatgaaatttctgacattgtcatatacaacgatgaatatcattaaaatttttaa

SEQ ID NO: 1584 - DNA, 1553 bp, Homo sapiens
tgccgcctcctcctgggctgggcgcggtgtctcgtcccctcgcggagcgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccatgcaggatatacgtactgtgggtcttgtgctgcccatgcttataaacaagtggatccgtctattacccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaaaaaaaa

SEQ ID NO: 1585 - DNA, 1341 bp, Homo sapiens
aggtgtttgggtttcttcgcggctgctcaagatgaaccgactcttcgggaaagcgaaacccaaggctccgcgccccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgccaacagtcattcaacatggacaggccattataccatccagtctttgaaggacaccaagaccacggttgatgctatgaaactgggagtaaaggaaatgaagaaggcatacaagccagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagg

SEQ ID NO: 1586 - DNA, 979 bp, Homo sapiens
ctggtctcccgcgtccatcggtccattcctgcgtcgttctgtccttccgaacgcacacttcaggagcagccgcgagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaaggggaagtctgctcgggtcatcaactatgaggagttcaagaaggccctggaagagctggcgaccaagagattccagggcaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagcccaggcatggctaacccctgactgcttgcctcatatttaagctgctgctctggccaagtgcctaattttaacccagacctcaataaagacaccttttgtaccaaaa

SEQ ID NO: 1587 - DNA, 1728 bp, Homo sapiens
cgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaacgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtccaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaattttaaaaaaaaaaaaaaaaaaaaaaaaaa

SEQ ID NO: 1588 - DNA, 3320 bp, Homo sapiens
ctagatgactgccagaagctcatagaacacggagtcaacactgcagaggacttagtccgagaaggtgaaatcgccatgcttggtggtgtgggagaagagaatgggaaactgtggagctttaccaaaaaggcctcgcacattcagttggacagcttaccagaagtacctttactggttgatgtgccttgtttatctgctcagttggatgactcaattcttaacatagtgaaagaccacatttttaagcatggaacagtagcatctcgcccaccagtacagatagaagaactaatagagaaacctggaggcatcattgtacgatggtgtaaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggagctggagcctgagctgctgttgcaggaggcccgcgagaacgtggaggcagcgcagagctaccggcgggagctgggtcaccggcttgaggggctgcgtgaggcgcggaggcagatcaaagaaagtgcatcacagacaagggatgttctcaaacagcattttaatgatttaaagggaaccgttggaaagctcctggatgagcgattggtgacccttttgcaagaggtggacaccattgaacaggagaccattaaaccactagatgactgccagaagctcatagaacacggagtcaacactgcagaggacttagtccgagaaggtgaaatcgccatgcttggtggtgtgggagaagagaatgagaaactgtggagctttaccaaaaaggcctcgcacattcagttggacagcttaccagaagtacctttactggttgatgtgccttgtttatctgctcagttggatgactcaattcttaacatagtgaaagaccacatttttaagcatggaacagtagcatctcgcccaccagtacagatagaagaactaatagagaaacctggaggcatcattgtacgatggtgtaaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgcgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcattaaaagtatagaagatataggaagttctatacccttccactgtacttctcaaagttggttattagaccaggaaaacttaatgtaatattatttttaaaatcatcttaaaggatccaagtccatgtaactctttagaacaagaggaataggtcagatagaagaagctgtgtaatgtattaatacatccgttcatgtgctgtccacatgaatgtgttgactgtgctctccatgttcaggtatttgtaagcagtgttgacttttatcccctcttcagtaatctttaagtccccaaaacattataattttttctttttttgttgagacggagtctcactcttgtcactcaggctggagtgcagtggtgtgatctcagttcactgcaacctctgcctcccacgttcaagcgatcctcctgcctcagcctcctgagtagctgggattacaggtgtcggccaccacacctggctaatttttgtatttttagtagagacagggtttcaccatgttggccaggctggtctttaactcctgacctcaggtgttccacccacctcagccttccaaagtgctaggattacaggcgtgagccactgcagtgggccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcgtatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattctattttaatgtgaattatttttttcatttttaccagtagtaaaaaagtagaaaagcaagtatgatatttttgtaagataatttatttggggattcatgttcccctgttagacaatcatgaccttttctacttgtctttttatatataagtagtagatttccacttgtttagggattaagaagatgttctagaatgtagataccttgtccagccataggaatcaaaataaaaaactaaaaaaaaaaaaaaaaaaaaaaaaaaaaaa

SEQ ID NO: 1589 - DNA, 1079 bp, Homo sapiens
ggtggtcgctgcccgtggtgctccgtcgcccccgccacctcacgtcctcccgtgcgtcgggagcgtctcggctacaacatgttgggcatgatcaagaactcgctgttcggaagcgtagagacgtggccttggcaggtcctaagcaaaggggacaaggaagaagttgcctatgaagaaagggcctgtgaagggggcaaatttgccacagtagaagtgacagataagcctgtggatgaggctctacgggaagcaatgcccaaggtcgcaaagtatgcggggggcaccaatgacaagggaattgggatggggatgacagtccctatttcctttgctgtgttccccaatgaagatggctctctgcagaagaaattaaaagtctggttccggattccaaaccaatttcaaagcgacccaccagctcccagtgacaaaagcgttaagattgaggaacgggaaggcatcactgtctattccatgcagtttggtggttatgccaaggaagcagactacgtagcacaagccacccgtctgcgtgctgccctggagggaccagccacctaccggggggacatctacttctgcacgggttatgaccctcccatgaagccctacggacggcgcaatgagatctggctgttgaagacatgagtgacccactgaaccaagaacttactggaagtgtgcctctgtgtctccttcctcgggggtaaggaggggacagtgcttcccaagttccagctgcaagtccaacttaaccaactttccttcaaagtcagttactgccaattttctgaaaaaagcatgttccatatactaagtctcttttctcacggtaggaaataatacagccaagatatgcagcatccttctcattgatgtagaaaattctgcgatagaccagaaaaatcctggcagcttttctccaggcatctgggtcactaaaaactgattttctaaaattattggatttgtattttgttattaagggggaaaatgtgatttgtgcctgatctttcatctgtgattcttataagagctttgtcttcagaaaaactaaaaataaaaggcattgacttaaa

SEQ ID NO: 1590 - DNA, 967 bp, Homo sapiens
ggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggggcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaaaaaaaaaaaaaaaaaa

SEQ ID NO: 1591 - DNA, 1379 bp, Homo sapiens
gcggcaacagcggggccgatgtgtagttggtgactgcctctccagatgctgaggtgcctgtatcattggcacaggccagtgctgaaccgtagtggagtaggctgtgccttctgaagcagtatctattcacaatgaagttgcagtctcccgaattccagtcacttttcacagaaggactgaagagtctgacagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccaggcttcatgaagaaaattttgagattactacactacggattgatgtcaccactgatggaagacatgctgaggtagaatttacaactgactggcagaaagatgcggaacgcagagatctcactataaattctatgtttttaggttttgatggcactttatttgactactttaatggttatgaagatttaaaaaataagaaagttagatttgttggacatgctaaacagagaatacaagaggattatcttagaattttaagatacttcaggttttatgggagaattgtagacaaacctggtgaccatgatcctgagactttggaagcaattgcagaaaatgcaaaaggcttggctggaatatcaggagaaaggatttgggtggaactgaaaaaaattcttgttggtaaccatgtaaatcatttgattcaccttatctatgatcttgatgtggctccttatataggtttacctgctaatgcaagtttagaagaatttgacaaagtcagtaaaaatgttgatggtttttcaccaaagccagtgactcttttggcctcattattcaaagtacaagatgatgtcacaaaattggatttgaggttgaagatcgcgaaagaggagaaaaaccttggcttatttatagttaaaaataggaaagatttaattaaagcaacagatagttcagacccattgaaaccctatcaagacttcattatagattctagggaacctgatgcaactactcgtgtatgtgaactactgaagtaccaaggagagcactgtctcttaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcattt

SEQ ID NO: 1592 - DNA, 2127 bp, Homo sapiens
atggcgacggagcagaggcctttccacctggtggtgttcggcgcgtctggcttcaccggccagttcgtgaccgaggaggtggcccgggagcaggtggacccggagcggacccagcctgccctgggcgtggcgggccgctcccgggagaagctgcagcgggtgctggagaaggcggccctgaagctgggaagaccaacactgtcatctgaagttggaatcatcatctgtgatattgctaatccagcctcgcttgatgaaatggctaaacaggcaacagttgtcctcaattgcgtaggaccatatcggttttatggagaacctgtaataaaagcatgtattgaaaatggagccagttgtatcgacatcagtggagaacctcagtttctggaactaatgcaactgaagtatcatgagaaagctgcagacaaaggggtttatatcattggaagcagcggctttgactccattccagcagatctgggagtaatatataccagaaataaaatgaatggtactttgactgctgtggaaagtttcctgactatacattcaggacctgaggggttgagcattcatgatggtacctggaagtcagcaatttatggttttggagatcagagtaatttgagaaaactaagaaatgtatcaaatctgaaacctgtcccgctcattggtccaaaattgaagagaaggtggccaatttcttattgtcgggaactcaaaggttattccattccttttatgggatctgatgtgtctgttgtaaggaggactcaacgttacttgtatgaaaatttagaggaatcaccagttcagtatgctgcgtatgtaactgtgggaggcatcacctctgttattaagctgatgtttgcaggacttttctttttgttctttgtgaggtttggaattggaaggcaacttctcataaaattcccatggttcttctcctttggctatttttcaaaacaaggcccaacacaaaaacagattgatgctgcctcattcacgctgacattctttggtcaaggatacagccaaggcactggtacagataagaacaaaccaaatatcaaaatttgtactcaggtgaaaggaccagaggctggctatgtggctacccccatagctatggttcaggcagccatgactcttctaagtgatgcttctcatctgcctaaggcgggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctgtttttgcctagtttttcgccaatctacactgattttggactgttacctaagttgaaaaataaaaggttgtcaatcgaatggtggttaatgttggacctgccgatgtatttgtatagtggtagaaacatgctgcttaagtggcctaacctgtttcttgccaataagtaggcttatcattttatttttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaaattga

SEQ ID NO: 1593 - DNA, 1763 bp, Homo sapiens
aagcaattaacaaagaaggaacatttacagttcagttttatgatggagtaattcagttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtatcaggagttgggatttctcagcactgctaatgaagatcccctcttatagtccaataagcttatcaggacttccagagtcatgacatgaacagtttaattgaacccatccactctgggcaggtgactggaatagctgattaaaacataaatgctgcttttaggttaaccacaaaggaacaactcaggatcagtcgtgattgctaaagtattcacttttatcttttaggtaagagaaaagaaaaagataaggaaagaagagagaagagagacaaagatcactacagaccaaaacagaagaagaagaggcacctctggtactgaagattcctgctgattttgagaactggatggagaatactttcccatcaggggctggagagggagaagaaacctttttctacagaatcatcaggcatgggtaaggtggctaacgctgagatctctt

SEQ ID NO: 1594 - DNA, 1832 bp, Homo sapiens
gaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtcccccaaggaactctgtggaaatgatgacctagcaaccagtttggttcttgatccctatttaggttttcaaacacaccaaatgaatactagcgcctttccttcgaggagctcgaggcatttttccaaatctgacagtttttctcacaacaaacctgtgagatttaggcctattaaaggaaggcagggagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcggatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaagtaagtaagggagatttgataagcatatcttttaaaagtattttcacacaatttgctttataaagtgtgcttcagtagttttaaacttttaaatactcagagagactgggacttgtgagctttggctgcacttcaaggctctagacgtgatttgagtagaggcacagtctgtatcccatctctaacttcagtaccgtcctctagactatttttcttgaataccttggtaactggatatgagttcttcatcatatgttccaaggtcatcatatgttttaaacattttcaaggtgttagagactgtgatgatgtcgctaagtcctgcaagaagacaaaaggactgagtagaattaaattagactctatacattccagtgcctagccagtttgttagaaaagatgatggacttggggaattcatagcttctggccttaaggcttccaccttttcattgcttgctgacctttttcaaaacgaactgactcagttcagcagaccaccagtaccagactcagaattgtgatagaggagcattttgaacagtgccgtattgtgacatgctgtattggctactccagaaagtaggagtaaagatggaaaggagaaagaagcaacctctgagattccagtggtgtgtgggggccagatctgatgggaaa

SEQ ID NO: 1595 - DNA, 1282 bp, Homo sapiens
ctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaa

SEQ ID NO: 1596 - DNA, 808 bp, Homo sapiens
tctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaacaaaaaaaaaaagtcgacgcggccggcaatttagtagtagtag

SEQ ID NO: 1597 - DNA, 2056 bp, Homo sapiens
tcgcagacagctcgggggaacagtggcggcttcggccggcggtccttgcgctccccaacagcggcgcgggcgggtgagccgtcggggcacagtcccggtgctcttctgtttctcagtcttcgcgcgaccctcgtgcggtgccacacggggcgggctacgagctgctcatccagaagttcctcagcctgtacggcgaccagatcgacatgcaccgcaaattcgtggtgcagctgttcgccgaggagtggggccagtacgtggacttgcccaagggtttcgcggtgagcgagcgctgcaaggtgcgcctcgtgccgctgcagatccagctcactaccctgggaaatcttacaccttcaagcactgtgtttttctgctgtgatatgcaggaaaggttcagaccagccatcaagtattttggggatattattagcgtgggacagagattgttgcaaggggcccggattttaggaattcctgttattgtaacagaacaataccctaaaggtcttgggagcacggttcaagaaattgatttaacaggtgtaaaactggtacttccaaagaccaagttttcaatggtattaccagaagtagaagcggcattagcagagattcccggagtcaggagtgttgtattatttggagtagaaactcatgtgtgcatccaacaaactgccctggagctagttggccgaggagtcgaggttcacattgttgctgatgccacctcatcaagaagcatgatggacaggatgtttgcacgcctcacgtctcgctcgaacggggatcatagtgaccacgagtgaggctgttctgcgttcagctggtagctgataaggacgcatcgcaaaattcaaggaaattcagaatctaattaaggacgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactgtgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttcttgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgggtggaatatcattttaaaatgttcatgttctgttctatattttcttcacctactctccaaatattgtaatgcaaaaagtctcagtaatgatttggtagtattaattttgtggtcattgtttctcttcgataaatttattttcattaaatacttgttagagggttttgaaatgtttttcaaatatgtgaaatgtgaaactgctgtcttttatattaaagtaattaaagaaaatgtattgtgattgaaattattttggcctccacaagatggctctatgagtattcttccagggattctaatatttatttaaggtaataaaatcttgacatttataatctttc

SEQ ID NO: 1598 - DNA, 839 bp, Homo sapiens
ctctggccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcctgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccaaaaaaaaaa

SEQ ID NO: 1599 - DNA, 1325 bp, Homo sapiens
atgtggtcgagtgtaggctcccacgttggaccgggaccggtaggggtagctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgactttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaa

SEQ ID NO: 1600 - DNA, 703 bp, Homo sapiens
aagacggggattggccatcgcttccggaagttgtgagctttgtttcggagcgggacctccccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgattttcctttcctgactataaa

SEQ ID NO: 1601 - DNA, 644 bp, Homo sapiens
gcgccgcgcgctggcggggaccggcatggtttggagcaggagcggctcggcaggctggcttgacagggcggcgggactgcgggactgcggcactgcggcctctgggatggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtgatgtttatactaataagtttgctagtacagtgtcagttatttaaagtggtaatgcccgataatgtcttttaaatgtttgaggatgttttaaatacatgcattgtcttcacgaagaagatgtaaaaataatgaacaataaattgcggtggaaacctcttcttaaa

SEQ ID NO: 1602 - DNA, 1076 bp, Homo sapiens
cgcctggctgtttcccggcttcatttctcccgactcagcttcccaccctgggctttccgaggtgctgtcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaagtgtccactgcaatggcaaagatatttccagttgcactgtatctctggaagtgatgcatgaattcgattggattgtgtcattttaaagtattaaaaccaaggaaaccccaattttgatgtatggattacttttttttgtaaacatggttaaaataaaacttctgtggttcttctgaatctt

SEQ ID NO: 1603 - DNA, 1830 bp, Homo sapiens
gcgaccgctcgtccgcccggcttgaggcccgcggggagcgcgccgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccggattgatgaactcccagagggcgctgtgaagcctccagcaaacaagtatcctatcttcttttttggcacccatgaaactgcatttctaggtcccaaagacctttttccatataaggagtacaaagacaagtttggaaagtcaaacaaacggaaaggatttaacgaaggattgtgggaaatagaaaataacccaggagtaaagtttactggctaccaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaagggacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattggtccttcagttttgaggccatgtgtaaagtttaaccatattgtaaaatatctattccgtattagaaatagctagttgacagcttatacttctcaacattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtga

SEQ ID NO: 1604 - DNA, 3757 bp, Homo sapiens
gcttgccacatgtactatgtggagagatgtaccaccctgcatcagcttttaccctacagaaggaaatcagcgttccattatattttattgttatcaacagtttaggaatacatagctttgcttttgcctttttctttccttccccttgtttcccctcgcctcagagaaaagaaggaaaaaaaaattcatctttcctacccccctctttttggatgataggacttgaagacaatctgaaataccacataaactcacttccagatgttttttgtttcatatgcaattgaattgggctcagactgtgtttttaagctgtatggtaaaaatatcactgtcttctagggccttattggggggcagggagagacgtgacactttgtcagaagggattgagtctgctaacttaaactctccttgattcaggaatacaaagtctccagctgtgaacagagactcatcagtgaaatagagtacaggctagaaaggtctcctatggatgaatcatggtgatgaacgttcacgtacggcagacgctgcctcgtggaaaactggaatggcaccattctttgagatgaagctgaaacattacaagatctttgagggaatgccagtaactttcacatgtagagttgctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaagtactatcaatcaatcatactactttggattgttgtgctggtgtaatgtggatttaacatcaataaatatttgacaaataaaaaaaaaaaaaaaaaa

SEQ ID NO: 1605 - DNA, 1398 bp, Homo sapiens
cccagccggtccaggcctctggcgaacatggcgcttgtcccctgccaggtgctgcggatggcaatcctgctgtcctactgctctatcctgtgtaactacaaggccatcgaaatgccctcacaccagacctacggagggagctggaaattcctgacgttcattgatctggttatccaggctgtcttttttggcatctgtgtgctgactgatctttccagtcttctgactcgaggaattgggaaccaggagcaagagaggcagctcaagaagctcatctctctccgggactggatgttagctgtgttggcctttcctgttggggtttttgttgtagcagtgttctggatcatttatgcctatgacagagagatgatatacccgaagctgctggataattttatcccagggtggctgaatcacggaatgcacacgacggttctgccctttatattaatcgagatgaggacatcgcaccatcagtatcccagcaggagcagcggacttaccgccatatgtaccttctctgttggctatatattatgggtgtgctgggtgcatcatgtaactggcatgtgggtgtaccctttcctggaacacattggcccaggagccagaatcatcttctttgggtctacaaccatcttaatgaacttcctgtacctgctgggagaagttctgaacaactatatctgggatacacagaaaagtatggaagaagagaaagaaaagcctaaattggaatgagatccaagtctaaacgcaagagctagattgagccgccattgaagactccttcccctcgggcattggcagtgggggagaaaaggcttcaaaggaacttggtggcatcagcacccccctcccccaatgaggacaccttttatatataaatatgtataaacatagaatacagttgtttccaaaagaactcaccctcactgtgtgttaaagaattcttcccaaagtcattactgataataacattttttccttttctagttttaaaaccagaattggaccttggatttttattttggcaattgtaactccatctaatcaagaaagaataaaagtttattgcacttctttttgagaaatatgttaaagtcaaaggggcatatatagagtaaggcttttgtgtatttaatcctaaaggtggctgtaatcatgaacctaggccaccatggggacctgagagggaaggggacagatgtttctcattgcataatgtcacagttgcctcaaatgagcaccatttgtaataatgatgtcaatttcatgaaaagcctgagtgtattgcatctcttgatttaatcatgtgaaacttttcctagatgcaaatgctgactaataaagacaaagccaccctgaaaaaaaaaaaaaaaaaaaaaaaaaaaa

SEQ ID NO: 1606 - DNA, 1860 bp, Homo sapiens
gcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggtgcgcgaacaccggagcgcacccgcagtcagctgagcgcgctggagcgcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacaaaaaaaaaaaaaaaaaagcggagctcacagagttcttggaataaaagcaacctcagaacaaaaaa

SEQ ID NO: 1607 - DNA, 4422 bp, Homo sapiens
gattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattaagctttcagtataaaaacaagtggctacctgatggaaacttttcttacccttatagggaaactgagcacaagctgaatgatattgtctgctgcaaaaaaaaacaaacaaaaaaaaaacaaaacaaaaaacaaaaaaaaaaaaaaaaaaacctcgtgccgaattcggcacgaggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccagatttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtggtacagaatcaaagaatcttcaggatggcagcaagtgtttacgagcccatatttggattggactatcgaacgagtagctttaaatgcaaaggtggttggagggccacatggagacaaagacaaaatggttgctgttgcctcagagagtagcatcatcttgtggagtgttcaggatgggggaagtggaagtgaaattggagtgttcagcctgggtgttcctgtagatgctctcttctttattggtaaccagttggtggccacgagtcatacagggaaagtgggagtgtggaatgctgtcactcagcactggcaggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcatcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcggttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaattta

SEQ ID NO: 1608 - DNA, 598 bp, Homo sapiens
gagcccggaaggtccggcgcccagagctaacgggagtcccaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaacacgtctaaagagccagttgattttgagcaatggattgaaaaagatttggtacacacagaggggcagcttcaaaatgaagaaattgtggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaaaaaaaaaaaaaaaaaaa

SEQ ID NO: 1609 - DNA, 1840 bp, Homo sapiens
atcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcagctgggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggggaaaaaaaaaaaaaa

SEQ ID NO: 1610 - DNA, 1551 bp, Homo sapiens
gcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctg

SEQ ID NO: 1611 - DNA, 999 bp, Homo sapiens
ccgctccctgcctggtctcccgcgtccatcggtccattcctgcgtcgttctgtccttccgaacgcacacttcaggagcagccgcgagaagccgggtggcatggcagcgagcacggacatagctgggccgaaggagagcttccggaagtttgccatccatggcgaccccaaggccagcgggcaagagatgaatggcaagaactgggccaagctgtgcaaggactgtaaggtggccgacggaaagtccgtaacacccctgtggacatcgtcttctccaaagtcaaggggaagtctgctcgggtcatcaactatgaggagttcaagaaaggccctggaagagctgcgaccaagagattcggggaagagcaaggaggaggccttcgatgccatctgccagctggtggcaggcaaagagccagccaatgtgggcgtcactaaagcaaaaacagggggtgctgtagaccggctgacggacaccagcagatacacgggctcccacaaggagcgcttcgatgagagcggcaagggcaagggcattgcgggacggcaggacatcctggacgacagtggctacgtgagcgcctacaagaatgcaggcacctacgatgccaaggtgaagaagtgaggcttgggaagaccgccctgccaagtgcggctgcccctgccagaggctcaggcctgggtctaaggggcacgtggagcaagagatcctggtcccctccctgctggacctgccacccagagcttcctgcctagtcccactgggctggcccaccaggcctctgacccaggctgctctgcggccccttcctcctcctcttcctgctccaacttctgtccacctggggacagtctgtgcctgtagcctcatgaccccaacccagccccaggcatggctaacccctgactgcttgcctcatatttaagctgctgctctggccaagtgcctaattttaacccagacctcaataaagacaccttttgtaccaaaaaaaaaaaa

SEQ ID NO: 1612 - DNA, 2393 bp, Homo sapiens
ggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagagtgggcagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcatgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactcttttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcctataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacacaaaaaaaaaaaa

SEQ ID NO: 1613 - DNA, 2083 bp, Homo sapiens
cacgaggcttgcggcaccgcccacccacaccccgtctgccccttgaccccaccacacgccgacgccatgcagtccagtggggagtcggaggcagcctccttcctgcctccgactccccactggactgcatggcgacggcgtgtggtggggcagtcagctaagccatttgcctaaggggctgtcgggcatctgcgtgctggggaccgacagtgtgggtgtgttaggaggatctgtatggagcacattgctgcctctggctaggacagggtggaaagggtggcgtggctacagcctgacccatgggcaccgtcctaccctttgttctgtgcttccgagtgtcagtcatgtgctggggtctgtgggcccatgactcagacggtgagctctgaccttcctgagccagggctttgctgtagttgtgcctggctcaggagctctaggacaaggggaccgctccaggtctgcatctacggtgtggcagggcccctcggcactcttgtgcactagtgtcatctttcccattgaaatgactgtgaggaccagaatgtgcacatgcagatgggcagctacttgtctgccttggccctttattacacaacttgctgggggtggagatgccaccccccggcagtcagagcccctttatgatgtcatggggctggttacatgactgccaaggggtgctgctggccacactgcactagcaagtttgccagatggaggacaagcgatcattgagtatggctcgctgtgaagaaagaaattcgagaggacaggatcatggcttggaaagggtgcctttccctccccagttgcagtcagagacctaccttcacccagcagatccttcccctgcctgggacgacccggggtccactgggagccctaacttgaggctgctgacagaagaaatcgctttccaacctctggccgaggaagcttcgttcagaaggccgcaccctgacggtgacgtcccgccccagggagaagataatctcctctccctcccctttccacagaaactgtggagactggtcagcagcaaccagttttcgtccatctggtgggatgacagtggggcttgtagagtgatcaatcaaaaactctttgaaaaggagattctcaaaagggacgtcgcacacaaagtgtttgccacaacttcgataaagagcttcttccgccagctaaacttgtatggcttccgaaaacggcgtcaatgcactttcaggaccttcacccgcattttctccgcaaaaaggctggtctccatcttgaataagttagagttctactgccatccttactttcaaagagactcccctcacctcctcgtgaggatgaagagaagagtgggtgtcaagtctgcaccaagacatcaggaggaggacaagccagaagctgctggatcctgtctggcaccagcagacactgagcaacaagatcacacgtctccgaatgagaatgaccaggtcacaccgcaacaccgggaaccggccggtcccaacacccaaatcaggagtggctctgctccaccagcaactcctgtgatggtgcctgattccgccgtggcgagtgacaacagtccagtgacccagccggccggcgagtggtcagagggcagccaggctcacgtcactccggtggccgctgtccctgggcctgcagcgctgcccttcctctatgtccctggatctcccactcagatgaattcttacgggcctgtggtggcccttcccacagcgtcccgtagtacccttgccatggacaccacaggacttcctgcacctggcatgctgcccttttgccatctctgggtaccggtgaccctagtggctgctggggctgcacagcctgctgcctccatggtcatgttcccccatctcccagctctgcaccaccattgcccccacagccaccgcacgtcacagtacatgccagctagcgatgggccccaggcgtacccagactacgcagaccagagcacatagagggcagcatttgggcagaatatgtgctggtcaataaatgtgtcagaaaatgagtaattttctgactgcccaaaaaaaaaaaaaaaaaaaaaaaa

SEQ ID NO: 1614 - DNA, 306 bp, Homo sapiens
atgtcagacgcagccgtagacaccagctccgaaatcaccaccgaggacttaaaggagaagaaggaagttgtggaagaggcggaaaatggaagagacgcccctgctgacgaggaaaatggggagcaagaggctgacaatgaagtagatgaagaacaggaagaaggtggggaggaagaaggtgatggtgaggaagaggatggagatgaagatgagggagctgagtcagctacggacaagcgggcagctgaagatgatgaggataacgatgtcgataccaagaagcagaagaccgacgaggatgactag

SEQ ID NO: 1615 - DNA, 830 bp, Homo sapiens
aaaggactcccaagaactggagctggaaggaacaggagtgtgtttcagcaaacagccttcatccaaaatggaggagccaggcccccgcttcagtcaagacctgcctagaaaaaggaagtggagcgggagcaccgtccagcctccgtgcagccgtggcgtgcaggactcgggtggctctgaggtcgcctggggaccccagaagggacaggctggcctgacatggaaggtgaaacaagcagcagcccctgccttcaggagaactctgcagactgcagtgccggggagctgaggggtcctgggaaggagctatggagtcccatccagcaggttacagccacatcctctaaatgggcgcgatttgtcctgccacctagaaaaagttcacatgtggacagtgagcagccaaggtctcttcagagggaccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggcaggttattaatcgagatacacttgttaggagggacagggttcccctaaggcacttttaaagatactctgtaagaaccattaacaataaacttactgtcaatcaaaaaaaaaaaaaaaaaaaa

SEQ ID NO: 1616 - DNA, 1271 bp, Homo sapiens
ttctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatttgaaacagattttctgaagaaagcagaagctctcttcccattatgacttcggaaatcacttatgctgaagtgaggttcaaaaatgaattcaagtcctcaggcatcaacacagcctcttctgcagcttccaaggagaggactgcccctcacaaaagtaataccggattccccaagctgctttgtgcctcactgttgatatttttcctgctattggcaatctcattctttattgcttttgtcattttctttcaaaaatattctcagcttcttgaaaaaaagactacaaaagagctggttcatacaacattggagtgtgtgaaaaaaaatatgcccgtggaagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctatacattgactgattcactttttcataaagtgagcatttattgagcattttttcatgtgccagagcctgtactggaggcccccattgtgcacacagggagagaacatgagtctctcttaatttttatctggttgctaaagaattatttaccattaaattatatggtgtggtgt

SEQ ID NO: 1617 - DNA, 704 bp, Homo sapiens
tgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgagaactgcacaacttgagcctgactgtacatcttcttggatttgtttcattaaaaagaagcactttatgtaaaaaaaaaaaaaaaaaa

SEQ ID NO: 1618 - DNA, 2180 bp, Homo sapiens
  Modified_base 2015: n = a,c,g, or t
gagttggcaggatggcagagggcaaggcaggcggcgcggccggcctcttcgccaagcaggtgcagaagaagtttagcagggcccaggagaaggtgctgcagaaattggggaaagctgtagaaaccaaagatgaacgatttgaacaaagcgctagcaacttctaccaacaacaggcagaaggccacaagctgtacaaggacctgaagaacttccttagtgcagtcaaagtgatgcatgaaagttcaaaaagagtgtcagaaaccctgcaggagatctacagcagcgagtgggacggtcatgaggagctgaaggccatcgtatggaataatgatctcctttgggaagactacgaggagaaactggctgaccaggctgtaaggaccatggaaatctatgttgcccagttcagtgaaattaaggagagaattgccaagcggggtcggaaactcgtggactatgacagtgcccgacaccacctggaggcagtgcagaatgccaagaaagatgaggccaagactgccaaggcagaggaagagttcaacaaagcccagactgtgtttgaagatctgaaccaagaactactagaggagctgcctattctttataatagtcgtattggctgctatgtgaccatcttccaaaacatttccaacttgagggatgtcttctacagggaaatgagcaagctgaaccacaatctctacgaggtgatgagcaaactggagaagcaacattccaataaagtctttgtggtgaagggactgtcaagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgagagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcaggttgcttcagagcctggagaggcaaagaagatggaagacaaggaaaaggataataagcttatctcagctgactcctcggagggccaagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactcagggaatatttaattctggttttagcattattagaataagactttatacattaactaaagtggagctttaatcactataaaaagcaaaagtatntatagacacagacacttgcctatacagagacataaccacacacactcagaggatagtgaacaaatctgtctttgacttacgacccattttgcaagacttaaagccgaaagaacacattttcagattgttaaataaagtctgattctgactaaaaaaaaaaaaaa

SEQ ID NO: 1619 - DNA, 489 bp, Homo sapiens
cgcgacaagatggcggataaggagaagaagaaaaaggagagcatcttggacttgtccaagtacatcgacaagacgatccgggtaaagttccagggaggccgcgaagccagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccgggggcgcggggggtgcagggcaggcccgagcagctcggtttcccgcggacttggctgctgctcccaccgcagtaccgcctcctggaacggaagcatttctcctttttgtataggttgaatttttgttttcttaataaaattgcaaacctcaaaaaaaaaa

SEQ ID NO: 1620 - DNA, 2366 bp, Homo sapiens
ggaggtcacaagctctggtgccccaaaatggctctggtcctcagatatagttggttgccaccctgggagtgagaggaaccaggaaagcagcacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagcatgaactccaggaccgcatctgctaggggctggttcagcagccgcccacccacctctgagtctgacctggaacctgccacagatgggccagcctccgagaccactaccctcagcccagaggccaccacctttaatgacaccagaatccctgatgcagctggtggcacggccggcgtgggtaccatgcttctgtcctttgggatcatcacggtgataggcctggctgtggccttggttttgtacatcaggaagaagaagaggctggagaagctacgccaccagctcatgcccatgtacaacttcgaccccacggaggaacaagatgagttggagcaggagctgctggagcatgggcgggacgccgcctctgtacaggctgctacttctgtgcaggccatgcagggcaagactactctgccctcccagggcccactgcagagacccagccggctggtgtttaccgatgtggccaatgccatccatgtgtgagtggcctgggacaagcctggacttctgatagagacccatcacggtgcctacagagctccccactccctgattgtcaagacctactctgaagatcttccctgccaagacacaagagggctgagccaggtcctagctgttctccagacccacctgctgactttagactctaagagagggccctagccaggctggacttctgaccactgacttctcctgacctgagggccctggcacagagggcatccctcatgctgagaaggtcaagagcctctgctggcttcctcatcccctgtccagatccctcacatcagggtctgccccgctaatgtggaggaaatgagggagatacggagtgggagggattgggggaggaaaggggaggtttccctctgttagggagagacctgttttttggaatctggagcctcctctggggtggggagaggaaaccacccaagttatagggacagggtagggcagcatctgttatgggccctgagaagcccagagatggagctgaaactgtccagtatgcaaggatgccaggagaagggcaattcacacccagggtccatccatactacggagggtccaggaggtctcccagccacccatccttggcaaccagatgttactggggccaagctaggatgggagctgagggggaaggaagtaggggaatggaagtggaaggatgcagcccccccagacctgccgagaggcctcatgcatgtgcatgagtgtgcccatgggcagacatgtgcctgtcccagcacagcgggcagaatgagattgtccacactggccccaccctccaagtcgacctctaccccatggtatgtagtggagcatcagggtaggctatcttctctgccttcaatcttcagggactgcagggaagagggaagcacgcacagcacggttcctctctccactgcattgtttcactgggctcacctgcttctgaaaacggctccctgtcttgggctctaatgaggatctggggttgggagaggctgttggtctgagggcagtaatcacaggctgcaggctagagggggcagttatgactgcctgaaagtgggtgagggattgcacttcagaaaaacatctaaaaaacttagtctatgtttgaattccccacctccatcccatctatgggaagagccgttcagtgtttagagagtggggagatgggtccctgcacttggcctctccataagccttggagggtcagggctgataccaggggtcctggcaagccattgggcagagacagaccacaagagcagggcatttttttacgctgggcatacatatgcacacaagcatgcacagaggcatgtcccgtgcccagcctctccaccgtcactgtccgctgctggctggaggggatgcaggggtagtgtatgcagaccttccactgggcaaatgccatgtgtcaggagggaaaggcctaggaagcccccatggggaaggttctggatttattccctcctctaaatgctataaatacgttagcacttgagtcgactggaggctgccaggaattcaggatgcatacagctgtaatttaacccagagcagctccacgtgagagcattaaagatgtaatgaagatgttt

SEQ ID NO: 1621 - DNA, 5634 bp, Homo sapiens
gccttttccctccggctcgggagcgtctcgcttgcgccccgggcccgcggcgcccgcgcggctgcgagcctcgggtggccgcgtgccggctccaggaagccggagagggcgcggcggccaggatggcgcggcacgggccgtgcggctagacgggagccgagggaaccgccggctcgcgccctccgttctttcccggagccggcttcacgcagggccgggaacggccgtgcctctgggatccgccttcgctgacgccgggcacctacctggacgcgagcgagcgagatgcccaaccccaaaaacagcaaaggcggccgcaaaaacaagcgcgccaacagcagcggcgacgagcaggaaaatggagccggggccctggcagcggcgggcgcggcgggagcggcggccgggggggccctggcggcggcggccggttgcggggcggcggcggcgggcgcgccgggcgccggaggcgcggcgggcgccggaggcgcggggactggcgccgcgaacgctgcggccgccgcgggggctgcggccgcgggcgatgccaaaaacgaagccccatgtgccactcccctgatctgcagcttcggtaggccggtggacctggagaaggacgactaccagaaggtggtgtgcaacaacgagcactgcccctgcagcacctggatgcacctgcagtgcttctacgagtgggagagcagcatcctcgtccagttcaactgcatcggccgcgcgcgcagctggaacgagaagcaatgccgccagaacatgtggacaaagaagggctacgacctggccttccgcttctgctcttgccgctgtggccagggccacttgaagaaggacacagactggtatcaggtgaagcggatgcaggacgagaaaaagaagaagtctggctccgagaagaacacagggaggcctcctggtgaggcggcggaggaggcaaaaaagtgcaggcccccaaataagccccagaaaggcccaagccacgacctcccccgccggcattccatggaccggcagaactcccaggagaaggcagtgggtgccgcagcctacggtgcccgttcccccggtggctccccgggccagtccccacccacgggctactccatcctctctcctgcccacttcagcggcccccgctcctccagatacctcggggagttcttaaagaacgccatccatctggagcctcacaagaaggccatggctgggggccatgtgttcagaaatgcccactttgattacagccctgcggggttggcagttcacagggggggacacttcgacacccccgtgcagttccttcggcggctggacctctccgaactcctcactcacatccccaggcataagctgaacactttccacgtgcgcatggaagacgatgcccaagtgggccagggggaagacttgcggaagttcattctggccgcgctcagtgccagccacagaaacgtggtaaactgtgccctgtgccaccgggcgctcccggtgttcgaacagttcccactggtggatggaactttgttcctaagcccgtcgagacatgatgagatcgaatatgatgttccttgtcaccttcaagggagactcatgcatctgtatgccgtgtgcgtggactgcctggaaggggttcacaagatcatctgcatcaagtgtaagtcacggtgggatggcagctggcaccagctgggcactatgtacacctacgacatcctggctgcctctccatgttgtcaggcccgcctgaactgtaagcactgtgggaagccggtgatcgacgtgaggatcgggatgcagtacttctccgaatatagcaacgtccagcagtgtccacactgtgggaacctggactaccacttcgtgaagccattttcctccttcaaagttctcgaagcttattgatgaaagctttgctttagtaatagctattttattgatattattactttattacatatcttttatagggaaacattctgtgacattaatttcctttctaatttaaaggagagttactttgttgtatgtgtgccactaaaataggggctgcccttgccctgtcttgattcccgagtgttaatctgtggttttgaccagagcccagatgggtaatcctgtgcatttgggttggggttcactcttaccaagaatctttgatgcagctttaagatggtggggaggatggggtgaatttaggaaaggaatttgtggttataaactaagagcttgataggagttggaaggaaactcttactaaaatgttaactttctaaaaaccttcttttagatcttccttgggcctttggaaaaatatgtgacaagtgaatgtaagtctgtgcctggagagctaatagtgcattagtctatctcagcctagtgttctgcagcacacatgggcaggcagtttactcacactgacaggtgacctgaaagtggcacaagtgctgtttctatcactattgtaatttgccagttcatttttcatgctgaaagtaatatccaaattgtaagacatatgaaagatattagtgttgcaaatatgtttaggtaaactgacctataacagaatatgtgaaatgaatttggaaataatgcaagaaggcagaactcaatcatttaaattgtgtctttgaagttggtaatatagcttttaaggagaacccatgaataacctgatttgggcagtgatgatttattacaggttgcactgttgaagtgtcatttggtgtcaggttcttctcacaggtaaatctttcagccacagaatctaactggtgagcttcagaaccaataattgccacatttattgtcctcaaaattgcttatggccatgtttaaccaattaattctgagtttccaaaatcaaagatttgaccttaagagggaagggaaaaaagtgtgaaaggatgatgaagaaaataattttactatttcttttaaaagtatgttttggaaaatcaatgattttaatgcatagcagtatgtttgaaaaatagaccattctaaaaagcccatgataccttactgttgatgaaaaaggatgatcatatatatagaacttgattagtcagagcattgggcattccaaaatacagcctttggttcagtagattttaatgctttaaatagactgacgtcgcatacccttatagaattggaatatgatttctcaaaaattaatttgataatttcatgtatgatgtgcatatatgctaaaagaatgcagaaaatcattttatgaatagccaaatttggggttgatgtgaacattttatgttactcatttggtttatacttttttttttttttttttaactgtgtggtttttcttttcagaagtatttaggcaatattgcacgtgagtttcagttctttttttcttttttttgagatggagtctcactcttgtcacccaggctggagtgcagtagtgcgatctcagctcactgcaacctctgcctcctggattcaagcgattctcctgtcccagcctcccaggtagctgggactataggcacgtgccaccacacccggctaattttttgtatttttagtagagacagcgtttcaccatgttagctaggatggtctagatctcctgaccttgtgatctgcctgcctcggcctcccaaagtgctgggattacaggcgtgagtcactgcgcctggccaagtttcagttctatatgaagtatttgatgttttgtttgaaacaatacagcattaaagaaccaatgttattcactaatatcattcatctttcagtttggatgatttggtttgctgcatctaggtcggtgtttgatcatctgaaaaaacatttcagtgggaagaaatgcataaaatgcctataagaagtagaaagtcattgaactgacagtgtttgatgcaactaaaagaggattgtaagcatagctttctgcaaacttgtctttaatgcacaaagctgtagtggtgaattaactatctccttattgattctctcctgtacccagatgcaaaaagtgctaagtttctcttgtcctcgtaataccatttggattttatttctgaatttaaatagtaaaatatttatgatgctgatctttaacccacctaaaattttatagtgaaacctgctttatattgttgttctgaagcttacaattgacctatacattgcattcagcaagctcctgaatttagaactgccgtcagtgtagtgtatgctgtgttccatgttgcctttttagatggctttctaccccctgaacaataaataggatgaggttttactgtaattgggtaaagtttactcttggacattatttcgatgctaaagtaaggattctgtggatgttacttaaagagaaaagcataagagcatgaagcatatctgggaatatcttttgcctttaagacgattcattcttgtctagagggaaaatctggctgatttgggaataaaatataatcgaatattcaacaccatgaagataaatcttattttggaaatctactgaccttaataccccaagcttgccctgaatactttgattggaattggaatatatcaaaaaaggttagtatttttgttgtagttaggatactaaaaggatattagttacccaagagatccaatttgtttttctgatgaatagtgttcagtaaaatgaagcagtcttaagagtgactaataatttcaaagtgatttttcgtctattcttaatattttttaattatttatttttaagagttttataccttgagcagatacaatgatctgctttagtgagaggacaatttctgattgattgttttctcttcaggccatctcacctcttcattctcttgttacatttgaagcagttgatataatgggtttatactttaaaagatagacatggtgccatgaagttggggagttgggtgaattatcccattctagttacagaggagctttccttaaatgccctttaacttctaggttttgttcaagaagttcattttctgagtaaaagttattttcatatatgttgggggaaaattaactcatctaaaaagaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatattccgggtaattgaaagaaaatataatggatgggctccattaaaaccagctcaaaaataaattcttgtcagtaaagatttcttgtcaagatgtcttggattgcacttttgttgaggaaagacagtgtaaatagttaaagaatgttgataaaattgaaacatttggttgtggaattgtgtgtggttttagagggtttctgtttgtgaaatgtatgtattaaaaataataaaattccagaaactaaaaaaaaaaaaaaaaaaaaaaa

SEQ ID NO: 1622 - DNA, 1907 bp, Homo sapiens
gaattcggcacgagctcgtgccgaatcggcacgagcgcgggcccaggagcggcaggactcgggccggagcgtggccggacccccacccgccgaggggcccagggaggacgcggcagagtcacggtggcagcattgagagttggacacccgggtccttgaagtgatctctaggccccagccccaaatccgccaccattccgtgctgcggggacaccatggctccagaagaggacgctggaggggaggccttagggggcagtttctgggaggctggcaactacaggcgcacggtacagcgggtggaggacgggcaccggctgtgcggggacctggtcagctgcttccaggagcgcgcccgcatcgagaaggcttatgcccagcagttggctgactgggtccgaaagtggagggggaccgtggagaagggcccccagtatggcacactggagaaggcctggcatgcctttttcacggcggctgagcggctgagcgcgctgcacctggaggtgcgggagaagctgcaagggcaggacagtgagcgggtgcgcgcctggcagcggggggctttccaccggcctgtgctgggcggcttccgcgagagccgggcggccgaggacggcttccgcaaggcccagaagccctggctgaagaggctgaaggaggttgaggcttccaagaaaagctaccacgcagcccggaaggatgagaagaccgcccagacgagggagagccacgcaaaggcagacagcgccgtctcccaggagcagctgcgcaaactgcaggaacgggtggaacgctgtgccaaggaggccgagaagacaaaagctcagtatgagcagacgctggcagagctgcatcgctacactccacgctacatggaggacatggaacaggcctttgagacctgccaggccgccgagcgccagcggcttcttttcttcaaggatatgctgctcaccttacaccagcacctggacctttccagcagtgagaagttccatgaactccaccgtgacttgcaccagggcattgaggcagccagtgacgaagaggatctgcgctggtggcgcagcacccacgggccaggcatggccatgaactggccacagttcgaggagtggtccttggacacacagaggacaatcagccggaaagagaagggtggccggagccctgatgaggttaccctgaccagcattgtgcctacaagagatggcaccgcacccccaccccagtccccggggtccccaggcacggggcaggatgaggagtggtcagatgaagagagtccccggaaggctgccaccggggttcgggtgagggcactctatgactacgctggccaggaagctgatgagctgagcttccgagcaggggaggagctgctgaagatgagtgaggaggacgagcagggctggtgccaaggccagttgcagagtggccgcattggcctgtaccctgccaactacgtggagtgtgtgggcgcctgagtgtcctgacagcccttctgcaacgtttacccaccctggttcagagcccagcttctcctggagagccggaccctcagggccctgaaccgtcgctctctggctgctcctctgtcccttgagggaggaagtcctgggacccagggaggggaggggcctttgtctagggaagggactggtagggaagggacgagtctaggctgagggcaagatgggaggtcagaggtgacagaagcgttcaggggtgcctgggcctccccaggagctgtggactcagttcctgacctctgctttggggttcctggggtgggcttggggtgagtgtagttctggcctagcagcaccctcttgtggcttgttctagcgtgtattaaaacttgacacacacccacacacaaaaacaaaaaaaaaaaaaaaaaa

SEQ ID NO: 1623 - DNA, 2231 bp, Homo sapiens
ctttcaaatattttttattgaaatgacaataaaataaaaaaagaacagtgatcactttaaccaaacttactttacaaatataaaaaatataaccaaaacttgggaattccaggccacggcgcggggcgggagggggcgcggcgaggcccgccggcggggcaaaaccggcctgggccctggcggccgcaggagcgcgtgcggcgtggactttgccgggctcgccacacagccccagacccgtttaggaccgggagaccgaacgcagcgtccagccggggagtttcggcggcgttctccgggcaccgcgcgcgggaagccagacgcagcggggggacacatctcgcggtggcgttgccagagtgaggagttagcaggcaggacttgacgaggctctttggtttttctagtcctcaaccactgaagaagaagcttgatgcttggctgtcagaagacatgaattacgcacggttcatcacggcagcgagcgcagccagaaacccttctcccatccggaccatgactgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctggaattccagagcttttgtcctggctaaaacagttacaaataaaattgcataatcctcctaccatccattacccacccagtcaaggacaaatggatctatgtgtcacatctggcagccaacaaggtctttgtaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaagatgatccttactattttctccagtttaacaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaagaaggtttcatggctcatgtagacagggttattgatttctatagtaaccagaaggatgcaatactggcagctgcagacaagtggttaactggtttggcagaatggcatgttcctgctgctggaatgtttttatggattaaagttaaaggcattaatgatgtaaaagaactgattgaagaaaaggccgttaagatgggggtattaatgctccctggaaatgctttctacgtcgatagctcagctcctagcccttacttgagagcatccttctcttcagcttctccagaacagatggatgtggccttccaggtattagcacaacttataaaagaatctttatgaagaaattaaactaggttgggcatggtgcgtcacacctataatcccagcactttgggaggcagaggagggaggatcacttgaacccaggaattcaggctgcagtaagctacgatcacaccactgcactctggcctgcatgcactctggcctgcatggcagaacaagaccctgtctctaaaaaaagagaaagaaatcaaactaatcatgctgctcatggatttttccaataaatttcttgttttggcaggaagaaatgaacactggtattagacttaaagattaaatttcctcaaacatgtcctatctgtagtagttcaactagacaccttttaaagtgcctctaaattcatcagatggccaaactgtatttataatccacttaggcattttgaaaaactttcaacctgtaaaaagttacttttatcttggatttattatgaagaactttgtagttgctttgtaatttcccataaattgtctttgaaactaaaaaaaaaaaa

SEQ ID NO: 1624 - DNA, 1264 bp, Homo sapiens
ttgagactcgagtgaccaggtggaggagaggcaactttccctgtcgggcttgagttgggagaggagcagggcggccttgtagggacccgtccctgctcctgaccatcaccgtcactggggtcactgtgctcgtgttggtcctgaagagcatgaactccaggaggagagagccaatcaccttacaggaccctgaagccaagtacccgctgccattgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgaggcccaaggggacgcttgttttaccatgggccacggaatcttggaatcagaccagaccagacgagtgagcctaaaaaaacactggccgatcacctgggaatgattgctgggggcacaggcatcacacccatgttgcagctcattcgccacatcaccaaggaccccagtgacaggaccaggatgtccctcatctttgccaaccagacagaggaggatatcttggtcagaaaagagcttgaagaaattgccaggactcacccagaccagttcgacctgtggtacaccctggacaggcctcccattggctggaagtacagctcaggcttcgttactgccgacatgatcaaggagcaccttcctcctccagcgaagtccacgctcatcctggtgtgtggcccgccaacactgatccagacggcggctcaccctaacctggagaagctgggttatacccaggacatgattttcacctactaacaaacacctccatgtgctcagcaaatttgcatgtcccttttcatctgtttcagagtaagttcaatttcaccacggtaaactgggatgttttcaaaagtgccttgccatgtaccttcgcgcacacactggttctcctcttttgggtgtgggcctaacaaaaagggctcaaggggctggagactggctgctggggcctccttgcttggaggctggcaagagctccatttcagtatctttctccgtggttttgtgaaataaactcaagtacaaagcaaaaaaaaaaa

SEQ ID NO: 1625 - DNA, 2870 bp, Homo sapiens
aggtcgcaggcgggcgtgcgtggagcgggggccgcggccgcgccgcagagatgtgactcgggccgaaggccagctggagcgtcggcgctgcggggccgcgggggtcgaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctaatgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaaaaaaaaaaaaaaaaaaaaaaa

SEQ ID NO: 1626 - DNA, 3636 bp, Homo sapiens
tgagtcccggccggagccccacggccgcgggcggcgcctaggacggcgatccgcgccctggaggatccgccggccgcccggctccactacagctccagccgcctgcagcggggccctcctgaggccccagaggaagagaccatgaaagtgaggtcggccggcggcgatggagatgccttgtgcgttacagaagaggacctggcgggtgacgacgaggacatgccgaccttcccatgcacccagaagggccggccagggccccgctgcagccgctgccagaagaacctatctttgcacacatcggtgcggattctttacctcttcctggccctgctcctggtggccgtggctgtgttggcctctctggttttcagaaaagtggactctctctccgaagacatctccttgacccagtctatttatgacaagaagcttgtgttaatgcagaaaaatctccagggcctggatccgaaagccctgaacaactgctctttctgccatgaagctgggcagctggggccagagatccgaaaactgcaggaggagctggagggaattcagaagctgcttctggcccaggaggtgcagctggaccagaccttacaggcccaggaggtgctctccaccaccagcagacaaatctcccaggagatgggcagttgctccttctccatccaccaggttaaccagtctctggggctcttcctggcccaggtgagaggctggcaggccaccacagctggcctggacctctctctgaaggacctcacccaggagtgctacgatgtcaaggctgcagtgcaccagatcaacttcaccgtggggcagacttccgagtggatccacgggatccagcggaagacagacgaggagaccctgaccctccagaagattgtcaccgactggcagaactacacacggctcttcagcggcctgcgcaccacctccaccaagactggagaggcggtcaagaacatccaggccaccctgggggcctcctcacagcgcatcagccagaactcagagagcatgcacgacctggtactccaggtcatgggcttgcagctgcagctggataacatctcgtccttcctggatgaccacgaagagaacatgcatgatcttcagtaccatacccactacgcccagaaccgcactgtggagaggtttgagtctctggaaggacgcatggcttctcacgagattgaaattggcaccatcttcaccaacatcaatgccaccgacaaccacgtgcacagcatgctcaagtacctggatgacgtgcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggtgcccccggccctccaggaccaagaggattcaaaggagatatgggcgtgaaagggcctgttggcggcagaggcccgaaaggagaccccggcatcttgggccccctgggaccccagggtcctcaggggcaacctggagaggccgggcctgtgggagaaaggggccctgttggccctcgagggttcccaggcctcaaaggctcaaagggcagctttggaactggagggccgagaggacagccaggcccaaaaggggacatagggcccccagggccagaagggcccccggggtctccagggccctcagggcctcagggaaaaccgggaattgcagggaagacagggtcaccaggccagcggggggccatggggcctaagggtgaaccagggatccagggtccccctggtctcccggggcctccaggtccaccaggaagccagagcttctactgaggagggctgtggcagagccactgtcacacagaatgccggaggggcgcagagcagatccaggccccagaaagcctcacctacagacagctgtggtcctctgattccaatgagggggctccccagggctgaccctgcagctttgggctcccccatagtgactgtgccataggaaagcagcccctcctcacacatacatgtgcacatgcacacacatgcatgcacacacatgcacacatacacgcacatgcacacatacacatgcatgcacacatacacaggcatacatgcatgcacacatacatatgcacgcacacacacatgcacacatacacgtgcacacatacacaggcacacatgcatgcacacatacacatgcacacacacatgcacacatatatgcacaggcacacacatgtatgcacacacacatgcaccgcacacatatccatgcacacaaacacatatatacacatgcacatacacagatttttctgctggccaggtgggccaactgggtttcccctggctgggcaggaggagagggcagaggaagaccccctctcctgtgactgagcctgccagggaggcagctacctcgggaggaaggtctcacatctgtctttgggcacccatgctggccagcagtttcccagggctccctggggttgaaaagccccaaggaaacctttgcgggtggggcgttactgccaaaactccagaggcaaagtggacctggcaaccacaagaccctccccataagcaggggaccagcagacccgggagctgtcccctgtctgtcacagcacagtggggccacgaggctgacattctctggccttgcacacagtgccccctgagaagttcaacatttatttcttcacgtgtccaggaaaattcctcaattcatccttgcctctgcccttcaggagcagcctggaaggaatccaagcaggagtttcatctgcatgggggcactttgcaggccctggaacattgggcctgagtggagatgggagacagaggcaggccagaaggttctctctgcacagctgcctcccttgctctccctgagggtggcctgccccattccccaagggggctcctttggagtggtagggaggatcaggctgcagaagggccaaccccttgcaacagggcagctctcgcctcccgcacacggctctcctgatcacagctgcatgccgaccttgtcccaccgggacccacaatggcccgagccctctttgcatgggcagccagctggactaggagtgggaagggcctggacactcacagaggccccctctgtcatcactccttggcacccaccaacttcctgcacacactggcagagaggggcgctgggaaatcaccccacagggtggaggtctcctgttggctacactctaaagctgctttgccttcatgttcaaacagattcaggcaccaccccctccaccgcccgcaaggttagggcatagatttgtctccttcccaacacggacccagagagcagcccttccctgctcaaagcctttccgcaccctcctgactgtcctggatgtgcaactggtttgcactgcacaccccacggccatgtaactctcctgtccacatatgataataccattctgcatagtattactgactcagtaaagaactatttccaggagt

SEQ ID NO: 1627 - DNA, 1603 bp, Homo sapiens
ggtggtccaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgccctgcccaccgcccaccacactctggggctgcctgtgggcaaacatatctacctctccacccgaattgatggcaacctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttgggcatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagaggcccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataatactggctgaggcccctgtgtgatattgaaaaaaaa

SEQ ID NO: 1628 - DNA, 2024 bp, Homo sapiens; identical to SEQ ID NO: 175

SEQ ID NO: 1629 - DNA, 1125 bp, Homo sapiens
cggcacgaggacagaatcaggtgatggtccagaattaagagctgtcacctgtgtcattcactcacaatggaagaaatgaagaagactgccatccggctgcccaaaggcaaacagaagcctataaagacggaatggaattcccggtgtgtccttttcacctacttccaaggggacatcagcagcgtagtggatgaacacttctccagagctctgagcaatatcaagagcccccaggaattgaccccctcgagtcagagtgaaggtgtgatgctgaaaaacgatgatagcatgtctccaaatcagtggcgttactcgtctccatggacaaagccacaaccagaagtacctgtcacaaaccgtgccgccaactgcaacttgcatgtgcctggtcccatggctgtgaatcagttctcaccgtccctggctaggagggcctctgttcggcctggggagctgtggcatttctcctccctggcgggcaccagctccttagagcctggctactctcatcccttccccgctcggcacctggttccagagccccagcctgatgggaaacgtgagcctctcctaagtctcctccagcaagacagatgcctagcccgtcctcaggaatctgccgccagggagaatggcaaccctggccagatagctggaagcacagggttgctcttcaacctgcctcccggctcagttcactataagaaactatatgtatctcgtggatctgccagtaccagccttccaaatgaaactctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggaaaaaaaaaaaaaaaaaaaaaaa

SEQ ID NO: 1630 - DNA, 2497 bp, Homo sapiens
acgccgccctccatttgccccggggcctcggctgcgaagatagcggcggccggacaggaagctcgaggaaagcgctgggccgggtctctacgaacacgtgaaggaaaagcagctccgtccacaacgccgcttcggggctcctagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgttttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcgttccaaactttcagatctctcaagattcagtagggaacagcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacgtcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacatttttttttaacttgatttaataaaaatgttaattttggaagtgcaaaaaa

SEQ ID NO: 1631 - DNA, 1740 bp, Homo sapiens
ggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaagaaacggcacattctgtattgggctcagatgcaaatgatgtagttattactgtcccgtttgattttggagaaaagcaaaaaaatgcccttggagaagcagctagagctgctggatttaatgttttgcgattaattcacgaaccgtctgcagctcttcttgcttatggaattggacaagactcccctactggaaaaagcaatattttggtgtttaagcttggaggaacatccttatctctcagcgtcatggaagttaacagtggaatatatcgggttctttcaacaaacactgatgataacatcggtggtgcacatttcacagaaaccttagcacagtatctagcttctgagttccaaagatccttcaaacatgatgtgagaggaaatgcgcgagccatgatgaaattaacgaacagtgctgaagtagcgaaacattctttgtcaaccttgggaagtgccaactgttttcctgactcattatatgaagggcaagattttgattgcaatgtgtccagagcaagatttgaacttctttgttctccactttttaataagtgtttagaagcaatcagaggactcttagatcaaaatggatttacagcagatgatatcaacaaggttgtcctttgtggagggtcttctcgaatcccaaagctacagcaactgattaaagatcttttcccagctgttgagcttctcaattctatccctcctgatgaagtgatccctattggtgcagctatagaagcaggaattcttattgggaaagaaaacctgttggtggaagactctcttatgatagagtgttcagccagagatattttagttaagggtgtggacgaatcaggagccagtagattcacagtgctgtttccatcagggactcctttgccagctcgaagacaacacacattgcaagcccctggaagcatatcttcagtgtgccttgaactctatgagtctgatgggaagaactctgccaaagaggaaaccaagtttgcacaggttgtactccaggatttagataaaaaagaaaatggattacgtgatatattagctgttcttactatgaaaagggatggatctttacatgtgacatgcacagatcaagaaactggaaaatgtgaagcaatctctattgagatagcatcttagtgttttagagaaatcaagaatttttaaaaacaagaatatcaacatttggttttgtgtataagtggtgtttgtattaaaatactttttcaatgaactgtataaactatgttttattaaactacaatatatcagtaaaaaaaaaaaaaaa

SEQ ID NO: 1632 - DNA, 1159 bp, Homo sapiens
gaacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaagg

SEQ ID NO: 1633 - DNA, 1110 bp, Homo sapiens
ccgccggcccccccggggccgctcgcgggcatggacagcgcggccgccgccttcgccctggacaagccggcgctgggcccggggccgccgccgcctccacccgcgctggggcccggcgactgcgcccaggcgcgcaagaacttctcggtgagccacctcctggacctggaagaggtggcggcggccgggcggctggcggcgcgccccggggccagggccgaggcgcgggagggcgcagcacgggagccgtccgggggcagcagcggcagcgaggcggcgccgcaggatggtgagtgtcccagcccggggcgcggtagcgccgccaagcggaagaagaagcagcggcggaaccgcaccacgttcaacagcagccaactgcaggcgctggagcgcgtgttcgagcgcacgcactaccccgacgcctttgtgcgcgaggagcttgcccggcgcgtcaacctcagcgaggcgcgcgttcaggtctggtttcagaaccgccgcgccaagttccgcaggaatgaaagggccatgctggccagccgctctgcctcgctgctcaagtcctacagccaggaggccgccatcgagcagcccgtggctccccggcccaccgccctgagtccagattatctctcctggacagcctcgtccccctacagcacagtgccaccctacagccctgggagctcaggccccgcaaccccaggggtcaacatggccaacagcatcgccagcctccgtctcaaggccaaggagttcagcctgcaccacagccaggtgcctacggtgaactgaagtccagtcccaccaggacccagacgcctccctgggtggacagcaatagaaaagggggcagacgcccaggaagtgaccttctcctggatgagctctcctggcccgtctgtccagcctggactcccgagcccacgaggctgttgaggcccctgcagccgggcccagctcttctgtccttggccaccagagactgcagcccacaacccttggaggggttgggccggaaggtggaagagcctgccaaggacctcatttagtttgtgtattaaaaccaaaaagcttttgtctttaagaaataaaaccatttttttaagcccc

SEQ ID NO: 1634 - DNA, 2836 bp, Homo sapiens
ctccctcagcgtccggccgaggcgcggtgtatgctgagccgctgccgcagcgggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttctttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacctgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgtccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgctaaaaaaaaaaaaaaaaaaaaaaaaaaaa

SEQ ID NO: 1635 - DNA, 1952 bp, Homo sapiens
agcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcaggctccacagactctcctggggcccagaggagctggtgctgacctagctagggatgcaagagtgagcaagcagcacccccacctgctggcttggcctcaaggtgcctccacccctgccctccccttcatcccagggggtctgcctgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctctgtgttgtgtgcgtggcagcctccaggaataaacattcttgttgtcctttgtaaaaaaaaaaaaaaaaaaa

SEQ ID NO: 1636 - DNA, 1833 bp, Homo sapiens
ggcacgagtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttgcaggatcagcaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggcccctccagccagcgtcaggtgcagaatggcccctctcctgatgagatggacatccagagaagacaagtgatggagcagcaccagcagcagcgtcaggaatctctagaaagaagaacctcggccacagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacggccagaagacgcatctggaggctccagtcccagtgggacctcaaagtccgatgccaaccgggcaagcagcgggggtggcggaggaggcctcatggaggaaatgaacaaactgctggccaagaggagaaaagcagcctcccagtcagacaagccagccgagaagaaggaagatgaaagccaaatggaagatcctagtacctccccctctccggggacccgagcagccagccagccacctaactcctcagaggctggccggaagccctgggagcggagcaactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgcaaaaaaaaaaaaaaaaaa

SEQ ID NO: 1637 - DNA, 2795 bp, Homo sapiens; identical to SEQ ID NO: 143

SEQ ID NO: 1638 - DNA, 2268 bp, Homo sapiens
  Modified_base 13: n = a,c,g, or t
gggatttgaaccncgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaatatcttgtaaatattcctgtattctcaacttttttccttttgtaaatttttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcaaaaaaaaaaaaaaa

SEQ ID NO: 1639 - DNA, 937 bp, Homo sapiens
aattcggcacgagggctcaggcagagtcctgcccctgcacccactcccccattcccggccccaggccatgccccaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctgtgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagaaaaaaaaaaaaaaaaaaaaaa

SEQ ID NO: 1640 - DNA, 2264 bp, Homo sapiens
gcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcataaagccaaggtagaagcaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctgaggtcccctcgtcccatccagctaccaccacggccaccactgcagccgggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatgcaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctatgcttaataaaagaacatgcttgaatatcaaaaaaaaaaaaaaaaaaaaaaaa

SEQ ID NO: 1641 - DNA, 850 bp, Homo sapiens
cccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgcaaacagctgcacagcaagtggcagaggataaatttgtttttgacttacctgattatgaaagtatcaaccatgttgtggttttaatgctgggaacaatcccctttcctgagggaatgggaggatctgtctacttttcttatcctgattcaatggatgccagtatggcactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatggaaaaaaaaaaaaa

SEQ ID NO: 1642 - DNA, 1046 bp, Homo sapiens
gtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacagatgaggaagatgaagattttgaagaagaaagtgatgatgatgatactgcagctcttcttgcagaactggaaaaaattaaaaaagaaagagctgaagagcaggccaggaaggaccaagaacaaaaagctgaagaagagaggattcgtatggaaaacattctgagcggaaaccctctccttaatctcactggcccatcccagcctcaggccaacttcaaagttaaaagaaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagtttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaataaaaaaaaaaaaaaaaaaaaaaaaaaaaaaa

SEQ ID NO: 1643 - DNA, 883 bp, Homo sapiens
cccggaagtacttgttgcctgagcagtgggctgcttaggaagagaaggtcagagttcgcgggggcagaggcattcttgccgctggcccagtcgctatgtagtggaggggcagacaccctcccgcaaattctggaaggtcttagtctcgactagggcagtagcccccaggactcctagtcgccggcttcaggtcactgccggctgaacggagctgccgtcgccatgtttggctgcttggtggcggggagctggtgcaaacagctgcacagcaagtggcagaggataaatttgtttttgacttacctgattatgaaagtatcaaccatgttgtggtttttatgctgggaacaatcccatttcctgagggaatgggaggatctgtctacttttccttatcctgattcaaatggaatgccagtatggcaactcctaggatttgtcacgaatgggaagccaagtgccatcttcaaaatttcaggtcttaaatctggagaaggaagccaacatccttttggagccatgaatattgtccgaactccatctgttgctcagattggaatttcagtggaattattagacagtatggctcagcagactcctgtaggtaatgctgctgtatcctcagttgactcattcactcagttcacacaaaagatgttggacaatttctacaattttgcttcatcatttgctgtctctcaggcccagatgacaccaagcccatctgaaatgttcattccggcaaatgtggttctgaaatggtatgaaaactttcaaagacgactagcacagaaccctctcttttggaaaacataatttgaataaaataatttttaatggtaaaaaaaaaaaaaaaaaaaaaaaaaaaaaaaaaaaaaaaaaa

SEQ ID NO: 1644 - DNA, 3039 bp, Homo sapiens
gcaccccgcccctgcggccgcctctcgcggctcccggggtccccagctccctgtccccggagccagagcccggctcccgcgcggctcccagccccgccgcgccgccccccgcatgctaatggccgggccgcctcccgccgcacacaatgcgggccagggccgggggcgggggaccggggagggggcgggggccgggccgggggcgggggggccggggcccggcgcatctcccccggccccacgtaacgctgacgcccgcgccgccggcccgccgcccgccgccgccgccgccgccgccgcccgctccgccgccgcccgcccggggctcctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggcccaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttaaggcacagg

SEQ ID NO: 1645 - DNA, 4221 bp, Homo sapiens
cgataacgatttgtgttgtgagaggcgcaagctgcgatttctgctgaacttggaggcatttctacgacttttctctcagctgaggcttttcctccgaccctgatgctcttcaattcggtgctccgccagccccagcttggcgtcctgagaaatggatggtcttcacaataccctcttcaatcccttctgactggttatcagtgcagtggtaatgatgaacacacttcttatggagaaacaggagtcccagttcctccttttggatgtaccttctcttctgctcccaatatggaacatgtactagcagttgccaatgaagaaggctttgttcgattgtataacacagaatcacaaagtttcagaaagaagtgcttcaaagaatggatggctcactggaatgccgtctttgacctggcctgggttcctggtgaacttaaacttgttacagcagcaggtgatcaaacagccaaattttgggacgtaaaagctggtgagctgattggaacatgcaaaggtcatcaatgcagcctcaagtcagttgccttttctaagtttgagaaagctgtattctgtacgggtggaagagatggcaacattatggtctgggataccaggtgcaacaaaaaagatgggttttataggcaagtgaatcaaatcagtggagctcacaatacctcagacaagcaaaccccttcaaaacccaagaagaaacagaattcaaaaggacttgctccttctgtggatttccagcaaagtgttactgtggtcctctttcaagacgagaataccttagtctcagcaggagctgtggatgggataatcaaagtatgggatttacgtaagaattatactgcttatcgacaagaacccatagcatccaagtctttcctgtacccaggtagcagcactcgaaaacttggatattcaagtctgattttggattccactggctctactttatttgctaattgcacagacgataacatctacatgtttaatatgactgggttgaagacttctccagtggctattttcaatggacaccagaactctaccttttatgtaaaatccagccttagtccagatgaccagtttttagtcagtggctcaagtgatgaagctgcctacatatggaaggtctccacaccctggcaacctcctactgtgctcctgggtcattctcaagaggtcacgtctgtgtgctggtgtccatctgacttcacaaagattgctacctgttctgatgacaatacactaaaaatctggcgcttgaatagaggcttagaggagaaaccaggaggtgataaactttccacggtgggttgggcctctcagaagaaaaaagagtcaagacctggcctagtaacagtaacgagtagccagagtactcctgccaaagcccccagggtaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagacattgccaagcccggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagtatgtgtaaaaatgtgatgctcagataagtacatttatatcagttcagtgttaaaatgcagtctcttgagttaaagtcatctttattttaaatgcagtgataaatgtcaactcttcggagaaactaggagaacaacaacagaaagctgtgtttgtcttttttctctcaaatatatctcccgtatgagatttcaggtccccatgttttcaccaagcaatctgctatgtcagccaacccaacatcactttctacaggaggttatgatttttgccatttactagaggaagatgttttatgaaatcaatttggggtttgaattcaggtgcagtcatcagttctttaggggctgcaatgttttaaaaaaaataagtcatcagattttaagaaaaaagtgatgatttcttattgatatttttgtaacagaatatagctcttaactgaaaatccagaaccagaaacataaatcttgagtttcttttcatgtacataaaaagcaatagccttttagtatagatagccctgagccaaaaagtaatagaattttctctagatatttaatacagagagtgtatagactgactctaagttaataatgtgcaaaatatcttaaacatccctccccttattcaacaattatgtatcagtgatcttgaaccattgttttatatttttcacctttgtaacctcatggaaagaggctttacatactttctatgtactatttacttagaagggagcccccttccagtcatgaaacttcatttgttttatccatatccctgaggactgtgtagactttatgtcagttctgtgtagactttatgtcagtttttgtcattatttgaaaatctattctgacaactttttaattcctttgatcttataagttaaagctgtaacaactgaaattgcatggatcaagtaagcatagttttatccagggagaaaaataaaaggaagccatagaattgctctggtcaaaaccaagcacaccatagccttaactgaatatttaggaaatctgcctaatctgcttatatttggtgtttgttttttgactgttgggctttgggaagatgttatttatgaccaatatctgccagtaacgctgtttatctcacttgctttgaaagccaatgggggaaaaaaatccatgaaaaaaaaaagattgataaagtagatgattttgtttgtatccctacccatctcctggcagccctactgagtgaaattgggatacatttggctgtcagaaattataccgagtctactgggtataacatgtctcacttggaaagctagtacttttaaatgggtgccaaaggtcaactgtaatgagataattatccctgcctgtgtccatgtcagactttgagctgatcctgaataataaagccttttacctt

SEQ ID NO: 1646 - DNA, 444 bp, Homo sapiens
atggtcacagggggcccctggcctaccaggctctccaggacatgtttgcactacttggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctcacttcttttctctgcaaaaggtgcttgtggggctgggagtgcagacattggtgtttctgctga

SEQ ID NO: 1647 - DNA, 597 bp, Homo sapiens
atggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctgcctctgccatcagctccggcaagaagaagcggaaacgctgcggcattgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtga

SEQ ID NO: 1648 - DNA, 435 bp, Homo sapiens
atgggtgctgtggtcctctgcaggccctcaccccttaacttcctcatacagactggcactgggcagggcctctcatgtggcagccacatgtggcgttgtgaggccaccccatgtggggtctgtggtgagagtcctgtaggatccctgctcaagcagcacagaggaaggggcaagacgtggcctgtaggcactgtctcagcctgcagagaagaaagtgaggccgggagcctgagcctgggctggagccttctcccctccccagttggactaggggcagtgttaattttgaaaaggtgtgggtccctgtgtcctcttccaggggtccaagggaacaggagaggtcactgggcctgttttctccctcctgaccctgcatctcccaccccgtgtatcatagggaactttcaccttaaaatctttctaagcaaagtgtga

SEQ ID NO: 1649 - DNA, 918 bp, Homo sapiens
atggcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttcaacacatcactgcattatttgaatgcagcatggcagctattatcaccttacttgtggagtgatccagttggtgttctttatattcgttcatgtcgagtattgatgcttcctgactggtacacgatgctttacagcccaagtccagattacgttaccacagtacactgtactcatgaagccgtctacccactatataccattgtatttatctattacgcattctgcttggtattaatgatgctgctccgacctcttctggtgaagaagattgcatgtgggttagggaaatctgatcgatttaaaagtatttatgctgcactttacttcttcccaattttaaccgtgcttcaggcagttggtggaggccttttatattacgccttcccatacattatattagtgttatctttggttactctggctgtgtacatgtctgcttctgaaatagagaactgctatgatcttctggtcagaaagaaaagacttattgttctcttcagccactggttacttcatgcctatggaataatctccatttccagagtggataaacttgagcaagatttgccccttttggctttggtacctacaccagcccttttttacttgttcactgcaaaatttaccgaaccttcaaggatactctcagaaggagccaatggacactga

SEQ ID NO: 1650 - DNA, 360 bp, Homo sapiens
atgcagagcagccacgcctactgcacacctctcaatgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtga

SEQ ID NO: 1651 - DNA, 1059 bp, Homo sapiens
atggcattggcgtccgggcccgcaagcgctaagcatggctccgggcagctcggccttgggggcttcggggcccgagacgcggggtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccgctcctctatgggaatgatgccaaggtcttggagcagcccgtggtggtgcagagcgtgggcacggatggacgtgtcttccatttcctag

SEQ ID NO: 1652 - DNA, 882 bp, Homo sapiens
atgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctga

SEQ ID NO: 1653 - DNA, 3160 bp, Homo sapiens
cagaaaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcagaataacatagctgatccagaagaactgttcacaaaattacagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaagctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttcgtcctacagcaaaagaacttctgaaacacaaattcattgtaaaaaattcaaagaagacttcttatctgactgaactgatagatcgttttaagagatggaaggcagaaggacacagtgatgatgaatctgactccgagggctctgattcggaatctaccagcagggaaaacaatactcatcctaaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagctttttttttaaaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaagcacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtcaaaaaaa

SEQ ID NO: 1654 - DNA, 3042 bp, Homo sapiens
cggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttgggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaaaaaaaaaaaaaa

SEQ ID NO: 1655 - DNA, 3179 bp, Homo sapiens
ccccccctttttgaaattatgtgctgctgtttaaaacaacaaacaaaaaaaacaacaaaaacacagcaactgcggattttgtccccggctggagcccagcgccccgcctggaatggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactttggccttcccaagtgatcacgctacgtggcaggggaattatagttttggtactcagactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagacaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggctcgcagctcggtgcaccgccaccccttccgcaatctgaacaccatgcgcccgcggctgcgctacagcccctactccatcccggtgccggtcccggacggcagcagtctgctcaccaccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgccaccaggcggggaggtgttcaaagacatctcctcagtgcggatttatatatatatttttcttcactgtgtcaaagtggaaacaaaaacaaaatctttcaaaaaaaaaatccggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaaaaaaaaaaaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgct

SEQ ID NO: 1656 - DNA, 1266 bp, Homo sapiens
gcgcgccgtccctgcgccccgctccgcccgcgcctctctcccagcgccgcgcctcgggcgtaaagagcgcgcccctcgcaccgcagccagtgccgaccgcagcagcccagccccagccttcctccgcctccgcctctctctcctcctcctcctccgccgccggacacgcagccgcagccgggaccgggacgcagctggggagtcagggacgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcgtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcgaagactggctacaacgtgaagcagctttttcgacgtgtggcgtcggctctacccggaatggagaatgtccaggagaaaagcaaagaagggatgatcgacatcaagctggacaaaccccaggagcccccggccagcgagggcggctgctcctgctaatgcagagccgacctgtggcttcccatgacactccttgcttgttgtgttgcttcctattggctagcttcctaaggggggagggaaccgagttatcaagatgggaggatttttcttttctctctgtctttaggagtagggtgggatggggagggaggctgggcatcagggatcacatcactcttaacggctgttacttaaacaactattttttggtttggttgtaatatattgtactttattaagattgccaaaaactgttaaaatttaaaaaaaatttaaatcatgtgtatacaattttttgc

SEQ ID NO: 1657 - DNA, 2113 bp, Homo sapiens
ggagttgagaattagggaggaggtggtagagtccgggtagtgagcggagggacaggaagggtagggcaagaaagggagaggggacaggagggaagggtgggccaaagcggtgagaaaggagggccagccagttgggtgggggagagggccgaggcccgggggcaggagtgcagggctctgaggcggggagaggagaggagagaagagccgcggggggcccagcccggagccaggatgcccgcgccgcgcgcccgggagcagccccgcgtgcccggggagcgccagccgctgctgcctcgcggtgcgcggggccctcgacggtggcggcgggcggcgggcgcggccgtgctgctggtggagatgctggagcgcgccgccttcttcggcgtcaccgccaacctcgtgctgtacctcaacagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggcgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctccc

SEQ ID NO: 1658 - DNA, 2114 bp, Homo sapiens
actgtttcacacttttctgcttctggaaggtgctggacaaaaacatggaactaatttccccaacagtgattataatcctgggttgccttgctctgttcttactccttcagcggaagaatttgcgtagacccccgtgcatcaagggctggattccttggattggagttggatttgagtttgggaaagcccctctagaatttatagagaaagcaagaatcaagtatggaccaatatttacagtctttgctatgggaaaccgaatgacctttgttactgaagaagaaggaattaatgtgtttctaaaatccaaaaaagtagattttgaactagcagtgcaaaatatcgtttatcgtacagcatcaattccaaagaatgtctttttagcactgcatgaaaaactctatattatgttgaaagggaaaatggggactgtcaatctccatcagtttactgggcaactgactgaagaattacatgaacaactggagaatttaggcactcatgggacaatggacctgaacaacttagtaagacatctcctttatccagtcacagtgaatatgctctttaataaaagtttgttttccacaaacaagaaaaaaatcaaggagttccatcagtattttcaagtttatgatgaagattttgagtatgggtcccagttgccagagtgtcttctaagaaactggtcaaaatccaaaaagtggttcctggaactgtttgagaaaaacattccagatataaaagcatgtaaatctgcaaaagataattccatgacattattgcaagctacgctggatattgtagagacggaaacaagtaaggaaaactcacccaattatgggctcttactgctttgggcttctctgtctaatgctgttcctgttgcattttggacacttgcatacgtcctttctcatcctgatatccacaaggccattatggaaggcatatcttctgtgtttggcaaagcaggcaaagataagattaaagtgtctgaggatgacctggagaaactccttctaattaaatggtgtgttttggaaaccattcgtttaaaagctcctggtgtcattactagaaaagtggtgaagcctgtggaaattttgaattacatcattccttctggtgacttgttgatgttgtctccattttggctgcatagaaatccaaagtattttcctgagcctgaattgttcaaacctgaacgttggaaaaaggcaaatttagagaagcactctttcttggactgcttcatggcatttggaagcgggaagttccagtgtcctgcaaggtggtttgctctgttagaggttcagatgtgtattattttaatactttataaatatgactgtagtcttctggacccattacccaaacagagttatctccatttggtgggtgtcccccagccggaagggcaatgccgaattgaatataaacaaagaatatgacatctgttgggcctcacaaggaccagggccttctggaggagtggcactaccccacctggcagcacctagacctgagctctacaaaaacacactgcttcactttgttttaggacttagttcaagaacacattcaaatggtgcatgtgtttggtatcttcaacagtagaccaagaatctaacatcactctcagtaatatagagaccggaatacatggtttataggaaatgatcaaatgatccaaaaaaactccacattttttaagaagttggaatttgatttcatgcataactgtattaaaacattaaatagaaataatgtcatttgaatgaaaatcttatcacattaaattcactgtgaaggcagcatacttaaaggaatttgatttcatgcataactgtattaaaacattaaatagaaataatgtcatttgaatgaaaatcttatcacattaaattcactgtgaaggcagcatacttaaatttttattttgaaaagtctaaaaggcttagatttttaaaatttaataattatttctacaaattttctatttttcttgaggtgattctcaactagcaattggaactcctaggctctattaacataattctttattgtaaacgtatctaatgctaaaagtaataaaatggtagttttctgag

SEQ ID NO: 1659 - DNA, 5470 bp, Homo sapiens
ccgcctctgtcgccactctctccccctgttccgcgtctgcgtcgccaccaccgccgggggtatccggggggtcgcttaccgggctggccccgcgccacagccgtagctttaacctccccgtcagcggccgccccaggaagaggcttctcggccgcggagccacttggggcctcagttctcgccctcttgccgtcgccgcgggtcctggagaagcggccgcggccagggaacggggcatcgcggttccaacgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacattgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagcttccacctgttaattatagtttgttaaagtttctgtgtagatttttagccaatgtagcatcacatcatgaagaaatttggtctgcaaattctttggctgctgtctttggtccagatgtcttccacatttacacagatgtggaagacatgaaagagcaagaaatagtgagcaggataatggctggacttctggaaaactactatgagttttttgagaatgaagaggaagatttttcatctaatgatttgagttcaattactgaacaggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaagcacccatatatctcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagattgatattgctgatgatattattaatgccagtgaaagtaacagagactgttcaaaacctgtggctagcactaatttagacaatgaagctatgcagcaagattgtgtatttgagaatgaagaaaatacccagtctgtaggtatattgttagagccatgcagtgaccgtggtgatagtgaagatggctgtcttgagagggaagaatatttgttatttgacagtgataaattgtcacacttgattctggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagccctcctacagtgatattgctgccaatccaaaggtattaaaatggatgacagagcttacaaaactgcggaagcaaattaaagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaagaaaatgaccaaagatcatttggtagaagagaaagcttctcttcagaaaagtcttctttactatgaaagtcaacatggaaggccggtgaccaaggaagaaaggcacattgttaaacctctctatgatagatacaggcttgtaaaacaaatgctgacaagagctagcatcactcctgtccttggatctccatccaccaagcgaaggggtcagatgttacagccaatcatagaaggagaaactgcacatttttttgaagaaatcaaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgcctgaattattggaacaactttggaaagccagagctgaaaaaaagaaactacgcaaaacgttgcgggaatttgaagaagcattttatcaacaaaatggaaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattccttgaagctatcatcgtgtgtacttggctggtacttaaattcgttttgtcaggcactcagagaatctcattttgtacttggttgtggtgccactaaacaaaacaaatgatgggagagtaagtaggccctctcaagggagcgtaagtgatgttccatattaaccacagactgtcctctccacctttagcaaacatatggtttacttcattgttttgtactacagatacatccttttagcaaaagactggaattttatcctttcaacttcaagaactttggaaatgcaagctttttgttattaccaactttttgtttctcattactgaagaaaattggaggaaaatcttcatactgaattcttctgttgcctttttcttacagaatgactgaaaatttgaaagaaaagcctataaaagtgcacatacgcaactgtgttctctgttttcctagaaaaccaaaatcaaactgagatttcaagtcgtactatggaacacctttctgtttaattcccaaagtgacatcttctcacaggtagtatgttagtaaaattttgcaattcgctggtcacacagctcccggatgaagataacagttggtagaccaaaaggtgacctcgcttagtatattgaaaacacacaccacacatcacacacagaactgaatcataccacatgctgcctatgggacttcagttactgtttcctgagttactgtttatccgctggcaatggtgtgatttgtctggatcagatccgcgctattccccaacccacctccagataatgtgagaaaatagccatgtcagtatgtaggaactctgatggtgctcagatttgtgtgttcaatcaatgggcttaaatcagcaaaatattatgcctaaagtaaatctgttcttaacaagggctctaccactgcattttcacatgtaccttcagggggttatctttttttttttcccctcctattttaatcagcaaaatccataccaaaacaacgacaacaacgccctcttaagggaccaccctttggtcaatcataacatgctgtttaaagcagctgtttacaggatgtgtagtggtatgccccttgtcatatactcttagcatatctttttttcctttggctttgcatggcttttcttcaggtactgtctcggtatcattctgctaatcattgttacagaatggtgacttcatttgtgctaacagtacaacagcagatttgggtcaggcttaatctaagtgttaacttttttttctggtgcttttttggattgatgactgtctcactttgactatacccatgttttgcatgcaatgactcatgcatggttttcttaactagctaatattaacaatttattccatataaaaatggaattttgcaacatcctttaataaggtgagggaagcatgaacctcagacttctggcactattacatagtaagcacatgaagtagtttgataataaatagcagttctagtacttcacatttcacccgtgtgtgcaatgcctttttctggggggtggggggtgagggaaaacctggtagtgaatgtgtagttggggaataaagaaaagcactaaatcctgccctttttgtgtggtttccttttgatacaactaggttattcataatgtatacctagaaaagtgaaattgaaaataccaaaagatgtatcatttttatttgaatccatcatgcagtgtacatttcagataatttccttcagtctccagataggagtgtatccaaacatctaattttatgtgcactgtgtatcttatatgaatgttttattttttataccacatgcaaaaatgtccatatgcactatttaaatgttttaaataatatattccttctttataatgctaaatctatatgagtaccatatttttataagtcagtggtctgactggtttcattttagaattaacagctgcttcaatatgttattcaatgttaatgtttggctgtgagtagaatatgtaaaagtggcatggcagcacttatgctctgtgacagtattgtgtgtcatagttgagcagtagctggtagaattaggcagttggtgatagttttactttggtacaaataaaaactgtatatctatatacaaataatatatagatatatatgtccaccagtataatggcattgctgtgtctggcacttcattgtacagacttttataataaaagaacttgaaagttctaaaaaa

SEQ ID NO: 1660 - DNA, 1429 bp, Homo sapiens
ccccctcccctcctgcagcctcctgcgccccgccgagctggcggatggagctgcgcagcgggagcgtgggcagccaggcggtggcgcggaggatggatggggacagccgagatggcggcggcggcaaggacgccaccgggtcggaggactacgagaacctgccgactagcgcctccgtgtccacccacatgacagcaggagcgatggccgggatcctggagcactcggtcatgtacccggtggactcggtgaagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacgggatagctgggagtatggccaccctgctccacgatgcggtaatgaatccagcagaagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctgccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcatttttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaatgtagcttttctgcttcactgtggcagcctcctccctggatccttagatcccagaggagggaagaaaatttgcagtgactgaaaacagtaaaaaaaaaaaaaaaaaaaa

SEQ ID NO: 1661 - DNA, 760 bp, Homo sapiens
gagttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctacaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgcttaagtacaactgatggcatgaaaaaaatcaaatttttgatttattataaatgaatgttgtccctgaacttagctaaatggtgcaacttagtttctccttgctttcatattatcgaatttcctggcttataaactttttaaattacatttgaaatataaaccaaatgaaatattttaactgataaaaaaaaaaaaaaaaaataaaaaa

SEQ ID NO: 1662 - DNA, 2056 bp, Homo sapiens
tgtacaaagtgcaatgtgaatttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgcccagaaaaaaacacaaaaaaagactttcatgaaagactctgtagtaggatcatccaaaaaatcagctacctacatatgtaagatgtgtccttttactacttcagccaaaagtgttttaaaaaagcacacggagtacttgcattcatcatcatgtgttgattcatttggtagtcctcttggacttgataaaagaaaaaatgacatccttgaagaacctgtagatagtgatagcactaaaacattaactaaacaacagtcaaccacatttccaaagaactctgctttaaaacaagatgtgaagcgaacatttggatcaacctcacaatcaagtagtttttcaaaaattcataagcggccacacagaatacagaaagctcggaaaagcattgcccaatcaggtgtaaacatgtgcaatcaaaacagctctcctcataagaatgttacaattaaaagcagcgttgaccaaaaacctaagtatttccatcaagcagcaaaagaaaagtctaatgccaaggcaaatagccactatttgtatagacacaaatatgaaaactataggatgatcaaaaaatcaggtgaatcatatcctgtgcatttcaaaaaagaagaagctagttcattaaattctttacacctgttttcatcatcaagtaattctcacaacaattttatttcagaccctcataagcctgacgccaaaaggcctgaaagcttcaaagatcacagacgtgtagctgtaaagagagtaattaaggaatctaagaaggaaagttctgttggaggggaagacttggatagctatccagattttttgcataaaatgactgttgtcgttttgcaaaaacttaattctgctgaaaagaaagatagttatgaaacagaagatgaaagttcctgggataatgttgagttaggagactacactacacaggccatagaagatgaaacctatagtgatattaatcaagagcatgtaaatttattccctttatttaagagcaaagtggaaggtcaggagcctggagaaaatgctactcttagttatgaccaaaacgatggcttttattttgaatactatgaagatactggaagtaacaactttttgcatgagatacatgatcctcagcatttagaaactgcagatgcttcattgtcaaagcatagttctgtttttcattggactgatttgtctcttgagaagaaatcgtgtccttactgcccagcaacatttgaaacaggtgttgggttatcaaatcatgtcagggggcatcttcacagagcaggattaagctatgaagcccgtcatgttgtatcaccagaacaaatagccacaagtgacaaaatgcagcatttcaaaagaactggcacaggaacacctgttaaacgagttagaaaagctatagagaagtctgaaaccacttctgaacacacttgtcagctctgtggtggttggtttgatactaaaattggattatcaaatcatgttagaagcccacttgaaagacttggaaagacgaaatgggatgctcacaaatctccaatctgggtctgaatgagatgatgcaaaatgaggaaaaatatgaaaaaatcttaaaggcattggaa

SEQ ID NO: 1663 - DNA, 1919 bp, Homo sapiens
ggggaggcgcgtcgagacagcgtgcctccttttgtgcgagcgccggcgctcggcttctcgaaggagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcactggctgaaggtaccttaacatggggaatcttcttaaagttttgacatgcacagaccttgagcaggggccaaattttttccttgattttgaaaatgcccagcctacagagtctgagaaggaaatttataatcaggtgaatgtagtattaaaagatgcagaaggcatcttggaggacttgcagtcatacagaggagctggccacgaaatacgagagggcaatccagcatccagcagatgagaagttgcaagagaaggcatggggtgcagttgttccactagtaggcaaatttaaagaaattttacgaattttctcagaggttagaagcagcattaagaggtcttctgggagccttaacaagtaccccatattctcccacccagcatctagagcgagacaggctcttgctaaacagtttgcagaaattcttcatttcacactccggtttgatgaactcaagatgacaaatcctgccatacagaatgatttcagctattatagaagaacattgagtcgtatgaggattacaatgtacccggcagaaggagaaaatgaagtaaataatgaattggcaaatcgaatgtctttgttttatgctgaggcaactccaatgctgaaaaccttgagtgatgccacaacaaaatttgtatcagagaataaaaatttaccaatagaaaataccacagattgtttaagcacaatggctagtgtatgcagagtcatgctggaaacaccggaatacagaagcagatttacaaatgaagagacagtgtcattcctgcttgagggtaatggtgggtgtcataatactctatgaccacgtacatccagtgggagcatttgctaaaacttccaaaattgatatgaaaggttgtatcaaagttcttaaggaccaaccctcctaatagtgtggaaggtcttctaaatgctctcaggtacacaacaaaacatttgaatgatgagactacctccaagcaaattaaatccatgctgcaataacaattctgggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgatataaataaaaatcagctttcatttttctaaaaaaaaaaaaaaaaa

SEQ ID NO: 1664 - DNA, 731 bp, Homo sapiens
gagcttaaactgaagcaagttcggtggacgccggcggcgccctgatctaaagaaacgactcagggactgcggcgcttgcacgtcaacgggaggtgtgagcccaaaggtctggacccagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaagggagaggataaagggaaggacaaggaatacataacatcaaacgtgggaatctggaaacatcaaagctggatttagaacatcttgccaccagctgaacaggccaaagccagactacagctggttcttgaagctgctgcaaaagctgatgaagcattgaaagccaa

SEQ ID NO: 1665 - DNA, 798 bp, Homo sapiens
agtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgttaaaaaaaaaaaaa

SEQ ID NO: 1666 - DNA, 1482 bp, Homo sapiens
gcttaagttgacctctgggtccggaatcgcgggcaaagatggcggcggccaggtgttggaggcctttgctacgcggtccgaggctttcattgcacaccgcggctaatgccgccgccacggctacagaaacgacctcccaagacgtcgcggcgacccccgtcgcgcggtacccgccgattgtggcctccatgacagccgacagcaaagctgcacggctgcggcggatcgagcgctggcaggcgacggtgcacgctgcggagtcggtagacgagaagctgcgaatcctcaccaagatgcagtttatgaagtacatggtttacccgcagaccttcgcactgaatgccgaccgctggtaccagtacttcaccaagaccgtgttcctgtcgggtctgccgccgcccccagcggagcccgagcccgagcccgaacccgaacctgaacctgcgctggacctcgcggcgctgcgtgcggtcgcctgcgactgcctgctgcaggagcacttctacctgcggcgcaggcggcgcgtgcaccgttacgaggagagcgaggtcatatctttgcccttcctggatcagctggtgtcaaccctcgtgggcctcctcagcccacacaacccggccctggccgctgccgccctcgattatagatgcccagttcatttttactgggtgcgtggtgaagaaattattcctcgtggtcatcgaagaggtcgaattgatgacttgcgataccagatagatgataaaccaaacaaccagattcgaatatccaagcaactcgcagagtttgtgccattggattattctgttcctatagaaatccccactataaaatgtaaaccagacaaacttccattattcaaacggcagtatgaaaaccacatatttgttggctcaaaaactgcagatccttgctgttacggtcacacccagtttcatctgttacctgacaaattaagaagggaaaggcttttgagacaaaactgtgctgatcagatagaagttgtttttagagctaatgctattgcaagcctttttgcttggactggagcacaagctatgtatcaaggattctggagtgaagcagatgttactcgaccttttgtctcccaggctgtgatcacagatggaaaatacttttcctttttctgctaccagctaaatactttggcactgactacacaagctgatcaaaataaccctcgtaaaaatatatgttggggtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaggaacaataatgatgagatttgtaactgtcaactattaaatacattgatttttgagacaaaaaaaaaaaaaaaaaa

SEQ ID NO: 1667 - DNA, 1729 bp, Homo sapiens
tcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctccccgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcaaaaaaaaaaaaaaaaaaa

SEQ ID NO: 1668 - DNA, 1076 bp, Homo sapiens
ggtttcaatatatgcagatgtctcgatataggaatgaaattacgtctttggaacaacttaaataagtcaaatatacttggagctttaaaaattaaaaggagagagattcgagcaccttttctgctgccatgacaaccatgcaaggaatggaacaggccatgccagggttggcctggtgtgccccagctgggaaacatggctgtcatacattcacatctgtggaaaggattgcaagagaagttcttgaagggagaacccaaagtccttggggttgtgcagattctgactgccctgatgagccttagcatgggaataacaatgatgtgtatggcatctaatacttatggaagtaaccctatttccgtgcatatcgggtacacaatttgggggtcagtaatgtttattatttcaggatccttgtcaattgcagcaggaattagaactacaaaaggcctggtccgaggtagtctaggaatgaatatcaccagctctgtactggctgcatcagggatcttaatcaacacatttagcttggcgttttattcattccatcacccttactgtaactactatggcaactcaaataattgtcatgggactatgtccatcttaatgggtctggatggcatggtgctcctcttaagtgtgctggaattctgcattgctgtgtccctctctgcctttggatgtaaagtgctctgttgtacccctggtggggttgtgttaattctgccatcacattctcacatggcagaaacagcatctcccacaccacttaatgaggtttgaggccaacaaaagatcaacagacaaatgctccagaaatctatgctgactgtgacacaagagcctcacatgagaaattaccagtatccaacttcgatactgatagacgtgttgatattattattatatgtaatccaattatgaactgtgtgtgtatagagagataataaattcaaaattatgttctcatttttttccctggaactcaataactcacttcactggctctttatcgagagtactaggagttaaattaataaataatgcatttaatgaggccacaggaaaaa

SEQ ID NO: 1669 - DNA, 929 bp, Homo sapiens
gggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaaggtaggtcctgggatgacagcaatgctgacactggcctaaggagttactcatccatttaataagtattccagcagatacagatgtgaacagtcaagtctctgccatccacaatgcttgtgttctaatgcaagaagacaaatattttcaataaagaaacaaatgccataaa

SEQ ID NO: 1670 - DNA, 3806 bp, Homo sapiens
ctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggtgccgggagccccgggcctgtcatggtggccatctacagccggcctgaggcagtcacagacggatttgcagctgagcctgtctatctggtgtgggaagaagatggggagttacttgtcagtcccggcttacttcacctccagagacctgtttcggtgttcagaatgccaggattccctcaccaactggtactatgagaaggatgggaagctctactgccccaaggactactgggggaagtttggggagttctgtcatgggtgctccctgctgatgacagggccttttatggtggctggggagttcaagtaccacccagagtgctttgcctgtatgagctgcaaggtgatcattgaggatggggatgcatatgcactggtgcagcatgccaccctctactgtgggaagtgccacaatgaggtggtgctggcacccatgtttgagagactctccacagagtctgttcaggagcagctgccctactctgtcacgctcatctccatgccggccaccactgaaggcaggcggggcttctccgtgtccgtggagagtgcctgctccaactacgccaccactgtgcaagtgaaagaggtcaaccggatgcacatcagtcccaacaatcgaaacgccatccaccctggggaccgcatcctggagatcaatgggacccccgtccgcacacttcgagtggaggaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgacacacaaagccacgggcaaagtgatggtcatgaaagagttaattcgatgtgatgaggagacccagaaaacttttctgactgaggtgaaagtgatgcgcagcctggaccaccccaatgtgctcaagttcattggtgtgctgtacaaggataagaagctgaacctgctgacagagtacattgaggggggcacactgaaggactttctgcgcagtatggatccgttcccctggcagcagaaggtcaggtttgccaaaggaatcgcctccggaatggcctatttgcactctatgtgcatcatccaccgggatctgaactcgcacaactgcctcatcaagttggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggaaagagctatgatgagacggtggatatcttctcctttgggatcgttctctgtgagatcattgggcaggtgtatgcagatcctgactgccttccccgaacactggactttggcctcaacgtgaagcttttctgggagaagtttgttcccacagattgtcccccggccttcttcccgctggccgccatctgctgcagactggagcctgagagcagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcacaggaagaggctgggggactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtctcagcaatctcttggtcttggcttcatggcaaccactgctcacccttcaacatgcctggtttaggcagcagcttgggctgggaagaggtggtggcagagtctcaaagctgagatgctgagagagatagctccctgagctgggccatctgacttctacctcccatgtttgctctcccaactcattagctcctgggcagcatcctcctgagccacatgtgcaggtactggaaaacctccatcttggctcccagagctctaggaactcttcatcacaactagatttgcctcttctaagtgtctatgagcttgcaccatatttaataaattgggaatgggtttggggtattaatgcaatgtgtggtggttgtattggagcagggggaattgataaaggagagtggttgctgttaatattatcttatctattgggtggtatgtgaaatattgtacatagacctgatgagttgtgggaccagatgtcatctctggtcagagtttacttgctatatagactgtacttatgtgtgaagtttgcaagcttgctttagggctgagccctggactcccagcagcagcacagttcagcattgtgtggctggttgtttcctggctgtccccagcaagtgtaggagtggtgggcctgaactgggccattgatcagactaaataaattaagcagttaacataactggc

SEQ ID NO: 1671 - DNA, 1021 bp, Homo sapiens
  Modified_base 912: n = a,c,g, or t
gagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccaccggaggtgggagaaaatctgggcacgatcgggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtcnttgacatttggggggaacagcaggtgccagagctaaaaggtacctttgtctgccattgatccagctcagaacgattggaaataaatttgaaatgtaaccgagcaaaaaa

SEQ ID NO: 1672 - DNA, 2905 bp, Homo sapiens
cggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtctgcaggaaccccgaacagttccccctggtgcagggagtggccataggtggctcctatggacggaaaacagtcttaagaggcaactccgatggtacccttgtccttttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggtccaccatccaggtgttcacaaaaaatcagagaatctctttcgaggtgctggccgccttcaacgctctgagcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaacggttctggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgtcctgcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccggggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctcggcatcttctggaaggtcaattacaactttgaagatgagaccgtgaggaagtttctactgagccagttgcagaaaaccaggcctgtgatcttggacccaggcgaacccacaggtgacgtgggtggaggggaccgttggtgttggcatcttctggacaaagaagcaaaggttaggttatcctctccctgcttcaaggatgggactggaaacccaataccaccttggaaagtgccgacaatgcagacaccaggaagttgtggagctaggatccatcctattgtcaatgagatgttctcatccagaagccatagaatcctgaataataattctaaaagaaacttctggagatcatctggcaatcgcttttaaagactcggctcaccgtgagaaagagtcactcacatccattcttcccttgatggtccctattcctccttcccttgccttcttggacttcttgaaatcaatcaagactgcaaaccctttcataaagctgccttgctgaactcctctctgcaggagccctgcttaaaatagttgatgtcatcactttatgtgcatcttatttctgtcaacttgtatttttttttcttgtatttttccaattagctcctcctttttccttccagtctaaaaaaggaatcctctgtgtcttcaaagcaaagctctttactttccccttggttctcataactctgtgatcttgctctcggtgcttccaactcatccacgtcctgtctgtttcctctgtatacaaaaccctttctgcccctgctgacacagacatcctctatgccagcagccaggccaaccctttcattagaacttcaagctctccaaaggctcagattataactgttgtcatatttatatgaggctgttgtcttttccttctgagcctgcctttatccccccacccaggagtatcctcttgccaaagcaaaagactttttccttggctttagccttaaagatacttgaaggtctaggtgctttaacctcacataccctcacttaaacttttatcactgttgcatataccagttgtgatacaataaagaatgtatctgg

SEQ ID NO: 1673 - DNA, 2894 bp, Homo sapiens
gaattccggtttcttcctaaaaaatgtctgatggccgctttctcggtcggcaccgccatgaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaaaccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaacccgagtcacccagctggtctcatacatagacagcacttgtgaaggattgaatgcaggttccaggtggagggaagacgtggacaccatctccactgagccatgcagacatttttaaaagctatacacaaaattgtgagaagacattggccaactctttcaaagtctttctttttccacgtgcttcttattttaagcgaaatatattgtttgtttcttcctaaaaaaaaaaaaaaaaaaaaa

SEQ ID NO: 1674 - DNA, 2574 bp, Homo sapiens
  Modified_base 200: n = a,c,g, or t
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttnatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgactccaccctcctacaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatgg

SEQ ID NO: 1675 - DNA, 1679 bp, Homo sapiens
agacttggaaaccccaaagtgtccgcgaccctgcacggcagctcccttccagcttcatgggcaaagtgtggaaacagcagatgtaccctcagtacgccacctactattacccccagtatctgcaagccaagtttggaaggcattcgggaataccaagtgaaaaggaagagtgaagaacagaaaaatgttagtgggatggcaaacactgtgaacattgctgtttctagtgggccagaaaaatcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtggcaaaggaaaccagagaaaacaagtatcggggctctgctatcaaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaa

SEQ ID NO: 1676 - DNA, 1924 bp, Homo sapiens
cgcccgggcaggttagaattcagcgaccgcttaattctaggctcagtcccgacgtggaactcagcagcggaggctggacgcttgcatggcgcttgagagattccatcgtgcctggctcacataagcgcttcctggaagtgaagtcgtgctgtcctgaacgcgggccaggcagctgcggcctgggggttttggagtgatcacgaatgagcaaggcgtttgggctcctgaggcaaatctgtcagtccatcctggctgagtcctcgcagtccccggcagatcttgaagaaaagaaggaagaagacagcaacatgaagagagagcagcccagagagcgtcccagggcctgggactaccctcatggcctggttggtttacacaacattggacagacctgctgccttaactccttgattcaggtgttcgtaatgaatgtggacttcaccaggatattgaagaggatcacggtgcccaggggagctgacgagcagaggagaagcgtccctttccagatgcttctgctgctggagaagatgcaggacagccggcagaaagcagtgcggcccctggagctggcctactgcctgcagaagtgcaacgtgcccttgtttgtccaacatgatgctgcccaactgtacctcaaactctggaacctgattaaggaccagatcactgatgtgcacttggtggagagactgcaggccctgtatacgatccgggtgaaggactccttgatttgcgttgactgtgccatggagagtagcagaaacagcagcatgctcaccctcccactttctctttttgatgtggactcaaagcccctgaagacactggaggacgccctgcactgcttcttccagcccagggagttatcaagcaaaagcaagtgcttctgtgagaactgtgggaagaagacccgtgggaaacaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcagtctggagggcagtatgagctttttgctgtgattgcgcacgtgggaatggcagactccggtcattactgtgtctacatccggaatgctgtggatggaaaatggtcttgcttcaatgactccaatatttgcttggtgtcctgggaagacatccagtgtacctacggaaatcctaactaccactggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgaccttatttataattagggatattatcaaaatatgtaaccatgaggcccctcaggtcctgatcagtcagaatggatgctttcaccagcagacccggccatgtggctgctcggtcctgggtgctcgctgctgtgcaagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgagcatctcttctccataagatagtgtgataaacacggtcatgaataaagttattttccccgaaaaaaaaaaaaaaaaaaaaaaaaaa

SEQ ID NO: 1677 - DNA, 854 bp, Homo sapiens
cccggatccctgcggctgcctgcactctggaccacgagctctgagagcagcaggttgagggccggtgggcagcagctcggaggctccgcgaggtgcaggagacgcaggcatggccggtgagctgactcctgaggaggaggcccagtacaaaaaggctttctccgcggttgacacggatggaaacggcaccatcaatgcccaggagctgggcgcggcgctgaaggccacgggcaagaacctctcggaggcccagctaaggaaactcatctccgaggttgacagcgacggcgacggcgaaatcagcttccaggagttcctgacggcggcaaggaaggccagggccggcctggaggacctgcaggtcgccttccgcgccttcgaccaggatggcgacggccacatcaccgtggacgagctcaggcgggccatggcggggctggggcagccgctgccgcaggaggagctggacgccatgatccgcgaggccgacgtggaccaggacgggcgggtgaactacgaggagttcgcgaggatgctcgcccaggagtgaggctccccgcctgtgtccccctggctgcgctctgagccttcagggccaccgcccgctgctgcttttgtgctgggactctccggggaaacctggtcggtggatgggaaactgcctccccctgggaggaaggctttgcgctccggggcctggatgcggcgccctcgggccgcctgcgagcccctctctgccttcagaccttgggcagaaggaggcctccttgggcctggtccccctttgccctgcagtggaatgagggccccttaaccccgcattgatctaaataaaggactgccgagttccaaaa

SEQ ID NO: 1678 - DNA, 4266 bp, Homo sapiens
ccgggctgtgagtctctcgccgccggaggaagatgaggctgaagattgggttcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcaacgtcaatgacttacgccaagaagaatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaagaacacttaaaagaaaaactggatgaatatattaagctgtggaatggcctagtgaaggtatttcgaaatgaaagaagggaaggtttaattcaagcacgaagtattggtgctcagaaggctaaacttggacaggttttgatataccttgatgcccactgtgaagtggcagttaactggtatgcaccacttgtagctcccatatctaaggacagaaccatttgcactgtgccgcttatagatgtcataaatggcaacacatatgaaattataccccaagggggtggtgatgaagatgggtatgcccgaggagcatgggattggagtatgctctggaaacgggtgcctctgacccctcaagagaagagactgagaaaaacaaaaactgaaccgtatcggtccccagccatggctgggggattatgtgccattgaacgagagttcttctttgaattgggtctctatgatccaagtctccagatttggggtggtgaaaactttgagatctcatacaagatatggcagtgtggtggcaaattattatttgttccttgttctcgtgttggacatatctaccgtcttgagggctggcaaggaaatcctccgcccatttatgttgggtcttctccaactctgaagaattatgttagagttgtggaggtttggtgggatgaatataaagactacttctatgctagtcgtcctgaatcgcaggcattaccatatggggatatatcggagctgaaaaaatttcgagaagatcacaactgccaaagttttaagtggttcatggaagaaatagcttatgatatcacctcacactaccctttgccacccaaaaatgttgactggggagaaatcagaggcttcgaaactgcttactgcattgatagcatgggaaaaacaaatggaggctttgttgaactaggaccctgccacaggatgggagggaatcagcttttcagaatcaatgaagcaaatcaactcatgcagtatgaccagtgtttgacaaagggagctgatggatcaaaagttatgattacacactgtaatctaaatgaatttaaggaatggcagtacttcaagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctggaaacctgctgcaactattgttattaactctgtatagctccaaacctggaacctcctgatcagtttgaaggacattgataaactgtgattttacaataacattatcatctgcagttactgtttacaagactgctttttaccttaaactttgtagatgtttacatcttttttgttgtgttttaaagatgatgttggtaatttgtgccttttagctctgttttattaaacagagttaaagcatgttgtcttctttgggattacactcaggggttctgaaaggcagtttgatttttatttttaacacacttgaaaaaaggttggagtaaccagactttcatatataacttggtgattatcaacctgttgtgtctttatttaattttacatctttttgaagcactgccacaggttattagccaaggtggccttccttcacagtcatgctgcttttttgaaaggtgaatttcaacacatttagtgcctctttcatttctcagtatatatttcaagagcttgtgatgaaatctataggatggtaatgatggacttgtcacctgtatggggaatacttttactactcagaaatgaatttatgtgctgccatttgctataaagttgaactttgtatggcttgaaaaagaaatgaccatatggaacatcccaaggctgtcccataagggttggaagttgtgtagcattcactcccttacctactggcattcccagtgccctctgtccatacctacttctaggattgcaaagggagtcttccaactagaagaaaaattgtccactgacatttgggatttacttttctccaatacctgccaatacagaaaactattatcagttgttattgttatcccttgaaaagcgagggtgacaaaaacaacaaaacaccgttataaacacatcaaaggttcattctgactgaggtaagactttccaagcccttgttagattaggccttataaaacttgtgtgcattataacctaagctgtgcaacctggtgaagccaagagtgaactgatgtttcatttatattttcatccaaatgacattatctgcacgtttttaaaatttaaaaacaaaggactatttaaaaatacagtttattaacaaacgtgaaactactttctgttacattaggtgttccctagtgtttcttaatttctttttagaaagtgtatttttattagtatttttccggtgaacagaagatttgtttggatttaaacatttactaagacagtacctattaggaaaaccaaatattgcaaatggtcaattcgattttaatttctcaaaagatactctgttatccagaagattaaaatgcctacattgagtgcttaaaaaaaaaaacaactgtgatgatgtgagcagaatggcaagtaagttaagcatttttgatcctgtaatcatggtatcattacaatgaaaggaattcacaaactactgccagaggaagtttgttttttaatttaagagggaaatataacctataaatttgtttcttccaagcttagctcttaaatttgggagactcaaagttaaacatcctcaacagagttttatttataattttgaattgtcaatttgtattttgctactgatctgtgatcaaccattttaactttcatctctagggatgtttaacatttataattgcaaaataaaccaactataaaaaaagaaactaagagagaattggtactttaattacttgtgtgtttgcaaataggctccattttccatgttgagtagattataaccttattaactaggcataggcctaagaaaggtggcaatgaactgtgcatgtaaattttaaatgggtactttgtgcaattcgttaaaagaagatactctatgaatatgattctatatattgaaatcagaaaacctaccaaacaaaaacatcagaagctgctgccataatgactattttctactgtaggctgctttggaaataattcccatatccttgctttgtaagttggtaatatcactatgcatttctacacattttataaatttgatttatgcagattttgatacactgtatgtttctgtagaaattgtataaatattcaaaattttattaggataaatttgagaaacttacgtatatcttaattctgggttgcttgttttttaggtgacaaaaataaaatattgtattttaattc

SEQ ID NO: 1679 - DNA, 1042 bp, Homo sapiens
cgcacggaacggcggtggtggcccgcggagcggacaggggcactatgaacgaagaggagcagtttgtaaacattgatttgaatgatgacaacatttgcagtgtttgtaaactgggaacagacaaagaaacactctccttctgccacatttgttttgagctaaatattgagggggtaccaaagtctgatctcttgcacaccaaatcattaaggggccataaagactgctttgaaaaataccatttaattgcaaaccagggttgtcctcgatctaagctttcaaaaagtacttatgaagaagttaaaaccattttgagtaagaagataaactggattgtgcagtatgccaaaaataaggatctggattcagattctgaatgttctaaaaacccccagcatcatctgtttaatttcaggcataagccagaagaaaaattactcccacagtttgactcccaagtaccaaaatattctgcaaaatggatagatggaagtgcaggtggcatctctaactgtacacaaagaattttggagcagagggaaaatacagactttggactttctatgttacaagattcaggtgccactttatgtcgtaacagtgtattgtggcctcatagtcacaaccaggcacagaaaaaagaagagacaatctctagtccagaggctaatgtccagacccagcatccacattacagcagagaggaataagtttttgaagagttaactcaccaagtgcaagaaaaagattctttggcctcacagctccatgtccgccacgttgccatcgaacagcttctgaagaactgttctaagttaccatgtctgcaagtagggcgaacaggaatgaagtcgcacctacccataaacaactgacctaaacagacttacttcgtatgccctgccctttattggtctcccagacatgcaaactttgaagaagtttgaagaaagttgtggtccgtttttttatggtcattaaatttgccaaacataaggcagtatttaacatctttgtcaaataaagcagatcattatactct

SEQ ID NO: 1680 - DNA, 1365 bp, Homo sapiens
aagaacgctggaggttgattggcggtcttgccggccagtgaagccagggcatgggcggggcgcggctcggagcgcgaaacatggcggggcaggacgctggctgcggccgtggcggcgacgactactcagaggacgaaggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagaaatgacgaagctgggccacgagctgatgctgtgtgcgccagatgaccaggagctcctcaagggctgtgcctgcgcccagaagcagctacacttcatggaccagttgctcgataccatccggagcctgaccattgggtgctccagttgctcgagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtgggccagtgcctctgccaagtccgaggaggaggagaagctggcggagcttgccaggcagctgcaggagagtgctgccaagttgcacgcgcttagaacggagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaactgctgcaagtggtcatggcagttgctgacacctctgcgaaggccgtggagaccgtgaagaagcagcaaggcgagcagatctgctggggtggcagcagctccgtcatgagtctagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttct

SEQ ID NO: 1681 - DNA, 2549 bp, Homo sapiens
atgggcctccccgagccgggccctctccggcttctggcgctgctgctgctgctgctgctgctgctgctgctgcggctccagcatcttgcggcggcagcggctgatccgctgctcggcggccaagggccggccaaggagtgcgaaaaggaccaattccagtgccggaacgagcgctgcatcccctctgtgtggagatgcgacgaggacgatgactgcttagaccacagcgacgaggacgactgccccaagaagacctgtgcagacagtgacttcacctgtgacaacggccactgcatccacgaacggtggaagtgtgacggcgaggaggagtgtcctgatggctccgatgagtccgaggccacttgcaccaagcaggtgtgtcctgcagagaagctgagctgtggacccaccagccacaagtgtgtacctgcctcgtggcgctgcgacggggagaaggactgcgagggtggagcggatgaggccggctgtgctacctcactgggcacctgccgtggggacgagttccagtgtggggatgggacatgtgtccttgcaatcaagcactgcaaccaggagcaggactgtccagatgggagtgatgaagctggctgcctacaggggctgaacgagtgtctgcacaacaatggcggctgctcacacatctgcactgacctcaagattggctttgaatgcacgtgcccagcaggcttccagctcctggaccagaagacttgtggcgacattgatgagtgcaaggacccagatgcctgcagccagatctgtgtcaattacaagggctattttaagtgtgagtgctaccctggctgcgagatggacctactgaccaagaactgcaaggctgctgctggcaagagcccatccctaatcttcaccaaccgcacgagtgcggaggatcgacctgtgaagcggaactattcacgcctcatccccatgctcaagaatgtcgtggcactagatgtggaagttgccaccaatcgcatctactggtgtgacctctcctaccgtaagatctatagcgcctacatggacaaggccagtgacccgaaagagcgggaggtcctcattgacgagcagttgcactctccagagggcctggcagtggactgggtccacaagcacatctactggactgactcgggcaataagaccatctcagtggccacagttgatggtggccgccgacgcactctcttcagccgtaacctcagtgaaccccgggccatcgctgttgaccccctgcgagggttcatgtattggtctgactggggggaccaggccaagattgagaaatctgggctcaacggtgtggaccggcaaacactggtgtcagacaatattgaatggcccaacggaatcaccctggatctgctgagccagcgcttgtactgggtagactccaagctacaccaactgtccagcattgacttcagtggaggcaacagaaagacgctgatctcctccactgacttcctgagccacccttttgggatagctgtgtttgaggacaaggtgttctggacagacctggagaacgaggccattttcagtgcaaatcggctcaatggcctggaaatctccatcctggctgagaacctcaacaacccacatgacattgtcatcttccatgagctgaagcagccaagagctccagatgcctgtgagctgagtgtccagcctaatggaggctgtgaatacctgtgccttcctgctcctcagatctccagccactctcccaagtacacatgtgcctgtcctgacacaatgtggctgggtccagacatgaagaggtgctaccgagatgcaaatgaagacagtaagatgggctcaacagtcactgccgctgttatcgggatcatcgtgcccatagtggtgatagccctcctgtgcatgagtggatacctgatctggagaaactggaagcggaagaacaccaaaagcatgaattttgacaacccagtctacaggaaaacaacagaagaagaagatgaagatgagctccatatagggagaactgctcagattggccatgtctatcctgcacgagtggcattaagccttgaagatgatggactaccctgaggatgggatcacccccttcgtgcctcatggaattcagtcccatgcactacactccggatggtgtatgactggatgaatgggtttctatatatgggtctgtgtgagtgtatgtgtgtgtgtgatttttttttttaaatttatgttgcggaaaggtaaccacaaagttatgatgaactgcaaacatccaaaggatgtgagagtttttctatgtataatgttttatacactttttaactggttgcactacccatgaggaattcgtggaatggctactgctgactaacatgatgcacataaccaaatgggggccaatggcacagtaccttactcatcatttaaaaactatatttacagaagatgtttggttgctggggggcttttttaggttttgggcatttgttttttgtaaataagatgattatgctttgtggctatccatcaacataagt

SEQ ID NO: 1682 - DNA, 3164 bp, Homo sapiens
cacatttcttagcttctctgagcctccatttcagcatctgtaaaatgttactacctactttataggttttctgatgaggcttaagtgtggttgtgcatgtgaccatcttagcatagtgtgtggcaatggtaagcactcagtgctgtcagctgtttttaccgctgttattatattactgtgttttcccatgtcattaggtctgtgatccaggcttcagcagacaatccaggctgatgcttttgctgagtgcgctaagggatgctggcctggcgggatggtgaactggaagcagaaacgtcatcctctctcttccttcttgccatgcaggtgtggatgtgtgggggccgcatggaggacatcccctgctccagggtgggccatatctacaggaagtatgtgccctacaaggtcccggccggagtcagcctggcccgggtaagaaccttaagcgggtggccgaagtgtggatggatgagtacgcagagtacatttaccagcgccggcctgaataccgccacctctccgctggggatgtcgcagtccagaaaaagctccgcagctcccttaactgcaagagtttcaagtggtttatgacgaagatagcctgggacctgcccaaattctacccacccgtggagcccccggctgcagcttggggggagatccgaaatgtgggcacagggctgtgtgcagacacaaagcacggggccttgggctccccactaaggctagagggctgcgtccgaggccgtggggaggctgcctggaacaacatgcaggtattcaccttcacctggagagaggacatccggcctggagacccccagcacaccaagaagttctgctttgatgccatttcccacaccagccctgtcacgctgtacgactgccacagcatgaagggcaaccagctgtggaaataccgcaaagacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctccccctgctctctgggtatttgaaatgtcaattttagcactctccaggcacaaggacagcccagcaccagctttacagggcagtgtttcagatggccctgagcccacggaaaaggccaggtagacctccaaactagaaatgctggctgatttgccctgatccatgcttccatttccctgtctctcttccccaggcaattactggcctcaaaagaggaacagaggtgctgcgaggtgctcacctcacagagtctggaggcctccaggatcaactgtgggcaaagtgcctgcctctgacctcatcatggttctagttctcatacagaactccagaatttttaaagaactctataattggattgcaaactaggatgctacataggattctggtattccacatccaatatggatttctagaatgctgtgattaaaggagccagccaggtgtaatacagtcaaggcagcccccagcctagagacaatctgtgaaatccaaagttggtggtgttgggaaagcagggggacatgtgtccctcagctcagcagaggctgtggtacaacatggtccttggtgaagacctgcacccctggaacctcccaccatcatcacaactgtagtctcatttgcagtggagaaaagaacccgacgtcccacagccagatatacacccagctccatgccagcccttcatgtttaccttttgctttgttaattacatgtcagactcctagagggcctccagactaataggaagcatttctgtaaccaacctgccacccactgattcagaaatggaaatcacattccacaatctatggcttccaccagctagcccaggaaatacttgaaatcagcattccaattagtgttgagtctcttgattgtgtcatttaccaattaaataactgagacctaagtctgggaacagagccacgaatctgcctttgagatgctggcagatctcaaggccatcaattattgggggagggagggacaaacactcccaatcatccaccagtcagactgaatgtgtagctggcgaggaattacttccacttctggcccagcacaagccctgctttggccacctgtctgcaagagaggcggcccctgtgcttgcaacgcttacgtgttgatcccagtgtccttttccaaatgagtgctgtagctttagaagtggccctctatagaaagaagtcaaaagatgaggccccttctagaatctaggataacaagagtgttgacagtttgaggagtcgaattgagattcatcatcaaagagcaatgcagcgtcgttaaaataaaaactgtgccttttaaaaagaaaaatgcaaatatagagcaaatccctaaacttgaaaaaaaaaaaaaaaaa

SEQ ID NO: 1683 - DNA, 3928 bp, Homo sapiens
gtgtgagtcccatgtgcttggtgggaggcgctgtgtgagaatgtacagggcaggaggaaacatagcagggctggggtgcagaggaggcccagagcagtgcactccagtctgcaggtactgcactgggcactggggagaccaacctggccccaggggcttccctgtggctgccttccagggcagtactaggtaaacaggtgcctgtgctgatgccatgttgctaggagtggaacggacaatcagccggagtactcaaggtgacccttggtctctgaatcctgaataacaaagagggtcagaaggaagagtgtcccaggccagtgctgaggccttgtggtggcgatgagctcagcctgttgaggcatggagcagagtgatgggagaggcacatgaggttgggggcctttgaggctgtggttgggaatttgtattttctcaggatggagtgaagacctggagaggaggggctctggctgctgtgtggggatgaattgtgggaagagggtgcagcactggaccccttccctgccacccatccacgtgcatcatcagtgtaatctctgattggattcctaattggggaggtcttgcccatctctagtcagtaactcactgtttctaagcctcctggaccatggcccaattcttctcccagtgaggtggttgctcagagtgccgacccttccatagggagtgagcagtgcaaagaaggtgccccctcctgaaccttgaagtgtagccattagggttttccctggggggccttctcactaattgtactctggtgctgccagagagaaggttgtcagcttcccactgctaggtggcagtagatggtggcagccctctctttccagggcaaggtctggtggatgaggtgcacatggttaatgcagagcagcttaacatccaccacagagggtgagccctgggataatgtgttgggaggcgtcctggggagggtgaggattgaagcagcccagtctgctgtggcgtgcgtgcttggcaagcatcctgttgtggcagtggccactgatgtttgatcgtgaatgtttatcttgggactgtcttgctgggccgggcccataggtgtagctgagcattcgtggggaatggacgccagcagagttgtaccagggcagagaggtcagggcagagaggtcaagacagatggtccgggctggggagaagttgaagggtccttgtgccagtcctcccctttttgtgtgctacctcatcttgccactgcagtgactttgggcagagggtgggacagggaccttttaaaatttttaaatggcatttcagcctgtgctccagttctccatgtggcaggcactgtgctggctgtcttcccagacacttgttatcttgttcacttgttccacaacaacctgtgaaatagctgtgagctccattggatccatggatgaggaacctgagaccaggaagtcacctgcctgatgccacagctcatgtggcagcactgagacttgaaccagggaattgtgtctgcagaagtggctgggccatttcctttacctctcagccacctttctgccagctccctgatgacaaacatcccggggccctggccacagcattgtagggctgggtcaggggagtggcaactgtcaggcagaggaaagaaccctgtagacagagaaaccaagccctgcaatgagtcctgttagatctccaggagttggggctccagaacctcccaagttatgttctcagagagattaattgctaccgctgtaaacagcagtgtttattacccctgctgtacacatcaggcagttgaggcccattcaggtgttggaactggctagggttacccagcaaattatccttggagttggaattaggtctttctattcagactgtagcttttggctcctgttcggaggtctatgggacagataatttagtggggattctttgtagtccagggcagcagttcttaacattgctgcatggtagaattacctgggaagctttaccaatttcaggcccttccttaggccaggtacttcagaacctcagagctccccagggggctccactccacagccaagggtaagaattcctggtctagggctgtgaggccacctccttgcacacctgaaaatgtttaaattggtattattctactgaaatggctgaggtggggtttggggtatcttgaaacaaatcaaactctgttactaattgagccctagctgggtgccaggccccaggtatgtgtgttgggagggagtgggctcttgaggcccaggagctgaggtttctgatagacttggggatgggattttggctgaaaaagaaagtcttttggggcaggagcttggaacccttgacccaaggagtcatggggaagatggggcaaggaggggtgggaaaataggtaattcatggctgcttctctaagatgtgcctgcctagccccagtaaacctacctccctccatccctgccaggccatggtggcgtgttacccaggcaacgggctcgggtacgtaaggcacgttgacaatccccacggcgatgggcgctgcatcacctgtatctattacctgaatcagaactgggacgttaaggtaggggtgagggtgagggtgagggtggcgctggggctagggctggggcgggggtggcgtgcgtccactccattttccactctcagcccagattctggcattctcctgtttctcttctcaacacacagcgggcagtgcgatctgccggctcttcctgggaaatggcacctcctcctctctagcggactgtgtggtgggaactcccctctttccgggaatggtgctgtctgcccagccccacccggccttgtaatgaacactttcccccttttcctgtctttagtagcttcctgcccatctccatggtgatgcagtctctgggttgtcattcactttgagagcccgaggggtgggagggagtgatgcaggcagacgctgcgcctcctagtgggctcccggggcaccgtgggaggcagcggctcctggccgtaccagctagcctcatcctttggcctgcccccaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgcaaaaaaaaaaaaaaaaaaaaaaaaaaaaaaaaaaa

SEQ ID NO: 1684 - DNA, 1549 bp, Homo sapiens
gctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggagttagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcaacacccctgggttcaggggtgcgccccggagaacaccttgcccactcccatggtcctgcagaggtgggacagtcacttcctcctccctccccacccctgtcgcatccacgtgcgacctggaggactggtcagaaccgttactgtgaatgagtgaagatcctggaggaccctggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgcaaaaaaaaaaaaaaa

SEQ ID NO: 1685 - DNA, 2487 bp, Homo sapiens
ctgagcgccctccgctcgccccgagagagacccggccatgcaggagccgctgctgggagccgagggcccggactacgacaccttccccgagaagccgcccccgtcgccaggggacagggcgcgggtcgggaccctgcagaacaaaagggtgttcctggccaccttcgccgcagtgctcggcaatttcagctttgggtatgccctggtctacacatcccctgtcatcccagccctggagcgctccttggatcctgacctgcatctgaccaaatcccaggcatcctggtttgggtccgtgttcaccctgggagcagcggccggaggcctgagtgccatgatcctcaacgacctcctgggccggaagctgagcatcatgttctcagctgtgccgtcggcggccggctatgcgctcatggcgggtgcgcacggcctctggatgctgctgctcggaaggacgctgacgggcttcgccggggggctcacagctgcctgcatcccggtgtacgtgtctgagattgctcccccaggcgttcgtggggctctgggggccacaccccagctcatggcagtgttcggatccctgtccctctacgcccttggcctcctgctgccgtggcgctggctggctgtggccggggaggcgcctgtgctcatcatgatcctgctgctcagcttcatgcccaactcgccgcgcttcctgctctctcggggcagggacgaagaggccctgcgggcgctggcctggctgcgtgggacggacgtcgatgtccactgggagttcgagcagatccaggacaacgtccggagacagagcagccgagtatcgtgggctgaggcacgggccccacacgtgtgccggcccatcaccgtggccttgctgatgcgcctcctgcagcagctgacgggcatcacgcccatcctggtctacctgcagtccatcttcgacagcaccgctgtcctgctgccccccaaggacgacgcagccatcgttggggccgtgcggctcctgtccgtgctgatcgccgccctcaccatggacctcgcaggccgcaaggtgctgctcttcgtctcagcggccatcatgtttgctgccaacctgactctggggctgtacatccactttggccccaggcctctgagccccaacagcactgcgggcctggaaagcgagtcctggggggacttggcgcagcccctggcagcacccgctggctacctcaccctggtgcccctgctggccaccatgctcttcatcatgggctacgccgtgggctggggtcccatcacctggctgctcatgtctgaggtcctgcccctgcgtgcccgtggcgtggcctcagggctctgcgtgctggccagctggctcaccgccttcgtcctcaccaagtccttcctgccagtggtgagcaccttcggcctccaggtgcctttcttcttcttcgcggccatctgcttggtgagcctggtgttcacaggctgctgtgtgcccgagaccaagggacggtccctggagcagatcgagtccttcttccgcatggggagaaggtccttcttgcgctaggtcaaggtccccgcctggagggggccaaacccccagtggctgggcctctgtgttggctacaaacctgcaccctgggaccaagaggcagcagtcatccctgccaccagccagagcacaggaagagcagtgtgatggggcctcagcagcgggtgcccctggctcgggacaggtagcactgctgtccagccacagccccagcccaggcagcccacagtgctgcacgtagccatgggccgcaggagtgcatacaaccctgcatccagggacacggccctgctgggtgacctcaggcctagtccctttcccttgcgtgaaggacacgccccacagaaggctacggggaggactgagaggacagggctggaggcagccaagtaacgtagtcatatcatcgcgctctgatctggtggcatctggctgtgcaaggaagacccggctttgccctcacaagtcttatgggcaccacagggaacatcctggacttaaaaagccagggcaggccgggcacagtggctcacgcctgtaatcccagcactttgggaggccaaagcaggtggattacccaaggccaggagttcaagaccagcctggccaacatggtgaaaccccgtctctactaaaaaatacaaaaaagctgggtgtggtggcacacacccgtagttccagctacttgggaggctgaggcagcattgcttgaacccgggaggtggaggctgcaatgagctgagatcatgccattgcactccagcctgggcaacgagagtgaaactccgtccccaccccctgccaaaaaaaaaaaaaaaaaagccagggcaaaggacctggcgtggccacttcctcctgccccagcccaacctctgggaacaggcagctcctatctgcaaactgtgttcacccttttgtaaaaataaaggaactggacccgt

SEQ ID NO: 1686 - DNA, 2695 bp, Homo sapiens
acgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacatcgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagcgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggcttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttccttcttgtttgttcctctgtgttctgtgtgcgtcttaagcaataaagcgtggccgtggctcgcgaaaaaaaaaaaaaaaaaa

SEQ ID NO: 1687 - DNA, 3674 bp, Homo sapiens
cagtagctaaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcttcccctatattctttccctcagctcttgggggccagaaatcccaaagggagtccgctgccccggccctccagggccgcctcctctgtttgctttgcagaggagggaactgctccttcgactctgcagctcaggcctgtccccgacacagcccccagggagtcttctagctacccctggcctctaggccgcctgacgctcagtgccttcctccgttccggggcctggtacccgtgccgggcagccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcgtgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcctgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaaaaaaaaaaaa

SEQ ID NO: 1688 - DNA, 2133 bp, Homo sapiens
agggatttccccatttctgtttgctgcctgaaagcaggatgaggaaggccaaggagagtccttgcacccgtgagcgtcaggatgaggaaatgacaggaggaagacgtgggtttgggttagtggctgctggcgttttggcccttggtgtttctggagcctccagggatctaggggagcctgggctgcgtgcatgtcgataagcagagctgttcttggggagaaggagggaggtctcgggagtgtagcaccatgccaaccagccctgcgcgaagacagagtgagccacgcccggatggcagggcatgtttctgttttggtgtctcactttcctcccagcgtgacttatttggggattcctcagggcctactggaatgtgactgcccactgcccagctgcctcgggtacaagtcctggccctatgtcccagctgtcaggggctcagggaatcctacccagccacctgtcctgggatggagtgtcagcatccaccccttggttgtcatcgaggccgccctcccagtcctgggtgaagatatttgggccaccagggctcccttggccccttcacgtaggaaatagacacgtgctttttaatgcaggacactttgagtgttacaaaatctgtagacctggcagtagggtcatgatgttgggaagggtgtagtgccctaggttggtgacagaagggacagacacttgtgcacaggtgtctttggtgatggggtttttttttttataacttagtaaaaaaaaaaaaaaatgtatgtggaattctgtctcttggtaaagctcaaagccaggctagcctgaggtggcgcagggctctccttcctgtcccttcgatctccttgagaattaagagctggcagctgctgatggtgtttcccaacccccctcacttcccaagacaacccccagcttcaggtcctcatggggaggggagggcacgttcttgacacatgggaacttcgctcaggagggcctccccttcccctctccctcagagttttcactgccgtctcgtctttagaaagctgtttgaattccccccgcccccagtttggaccgtgtagatataactggatatacggatttttctctttgtgcaggcttcttatgccgttggtatacagggcaggaaagagaggaataaagggagagagcagtgtggaaaccacggtggttttgctttgttcttactaggttttggtgccaccttccctgcctgcgcttgtgccccctctcctccttggcactggcggcctccttgcctcccttccacccgtgctgccatcccgtgcctgtcgtgttggttcttcacacgtgctctgttctcggggttgttccattcatgccttcttggagggtgagggtggcttgggaaccgacccagtgatcatgcctactttcttctttgtatctccctccttcccagcccacccgggcagcagactctgatggaaggaaggtgccgtaggtgggcttttagaaactaacgggactggttttcaaagcagttatcttgggaaactgtttattccagcgatgtgacttttttcagaatatttcttggaatcatattcagagtctggggctgtgtgttgagcagccttaaggatgctagacactcatttagtgcccagggagtccagcgaatgacgtctgtggccaagcgaggtctcaggtgcaaagcaaaaggaccatttaaagtaaaatagcttggattcaatcatgtgacttttaaattggctcagaaagcaattttgtaatttcagagagtgttttgagccatggccacgttgtcattgtgagtctatagcttgactccttggagaacaatattcatttggttgtggagactgatttgctgggagaaatctgtcctgttactttctggtcatcccaggttctgacttttaccaggggcaaaaaaaaaaaaaaaaagcaagagggagataaatcccatctgtgagtttgtcttattggcgcctttttcctcagctgtcttccaagtattatttttactgttaaaaaattttttaaaaatgtgaaatgtaatgtttttacagcaacaatatgaaatatattttataaggaataaaatggtaccttgtctgaaaaaaaaaaaaaaa

SEQ ID NO: 1689 - DNA, 1487 bp, Homo sapiens
tgtacttttattttacacagaaacactgcctttttatttatatgtactgttttatctggccccaggtagaaacttttatctattctgagaaaacaagcaagttctgagagccagggttttcctacgtaggatgaaaagattcttctgtgtttataaaatataaacaaagattcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcggggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggacgtcagacttggctcagctcggggagccttagccgcccatgcactggggacgctccgctgccgtgccgcctgcactcctcagggcagcctcccccggctctacgggggccgcgtggtgccatccccagggggcatgaccagatgcgtcccaagatgttgatttttgctgtgttttataaaatagagtgtagtttacagaaaaagactttaaaagtgatctacatgaggaactgtagatgatgtatttttttcatcttttttgttaactgatttgcaataaaaatgatactgatggtgaaaaaaaaaaaaaaaaa

SEQ ID NO: 1690 - DNA, 1702 bp, Homo sapiens
acaactgctaaagctccagagacacgagcgtgtgtggcagcaagagccgccagttcgggaccaccgcagctggggtggcagcggcgcaggaggggtcgcggggcgggagtggtgagcgcaggcggcaggggtctgggaaagacgaagtcgctatttgctgtctgagcgcgctcgcagctcctggaagtgttgccgcctctcggtttcgctctcgctcgctgcgctcctagaaggggcggccgcctccaggactgaccagggccaagtggcgctcggcgggcactacatggcggagggtgaagggtacttcgccatgtctgaggacgagctggcctgcagcccctacatccccctaggcggcgacttcggcggcggcgacttcggcggcggcgacttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagtgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaaggcccttcaaaggtacatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaaaaaaaa

SEQ ID NO: 1691 - DNA, 2571 bp, Homo sapiens
tacttgcgtcatggacagctcattgtaaatgatggcattaatttattgggtgtgttagaagaagcaagattttttggtattgactcattgattgaacacctagaagtggcaataaagaattctcaaccaccggaggatcattcaccaatatcccgaaaggaatttgtccgatttttgctagcaactccaaccaagtcagaactgcgatgccagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgactgtgcgaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaaaatgcaaagttgaagaactgtaacctcagaggagcaactctggcaggaactgatttagagaattgtgatctgtctgggtgtgatcttcaagaagccaacctgagagggtccaacgtgaagggagctatatttgaagagatgctgacaccactacacatgtcacaaagtgtcagatgagaattttaggggctggaggaagatgtaaaagatgaaaatgttttccttatcacttttctttctccacccactcagttgtctagaagaaataacactgtaaggaaatttaaaaaaaaaacatttagaggattatgcttgttttgagtggtgcataagggaaaaaactgactttttttccatattctgatttttaacagaaaagcactcatttaatagatgtagggaaactagatattgctgccttttgaatggggtaggggggtttacctggttttatgaccaggcatagtatctattatatttgcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaatgccaaatagtttacatagggccagcttagaaatagatactaaatccagagctactgcaatcaaagcttatatgagtgaatatggtagagttgcctgctaaaaggcaatgtaatataattgcagctagaaccctacagtggggaatgaggaattttaaacacacatttgattgcagccaccaaaaaaaatagacgtaaaaataaaggcatttggctggtccaagatgtaattatcaatcagtcagcacctgtgattcttttacttatttttttgtggtttttttttttaaacaaattttagcccaattttcttgagtcattctctctctgcagcagcagaggaagggcctgtacctccctaccaatgacttggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttattatttttaccaagacagagaagtattgtattgagagataatctattttcataatcaatatgtgcctaaattatatttaaatcatttcactctgtactatattttcaggaattacagaatgtggtattcattcacttaaaggtacctctgtagaaataacctaaaactgcagaaggatctgaaagatctaaacatggtgtgcttagaaactgcagattttagatctaatgtatactgcattaataaatgatataaagtgtttgttgaaaaaaaaaaaaaaaaaaaaa

SEQ ID NO: 1692 - DNA, 1749 bp, Homo sapiens
accaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctacggcttagaggtatctgatgtctcgaagtgggaagagtctgttcttgaacctgctcttgaaatcgtgcaaagtttcatccagggccacaagcctacagccactccaataaagatgccatacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcagaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaatttaaaaaaaaaaaaaaaaaaaaa

SEQ ID NO: 1693 - DNA, 2450 bp, Homo sapiens
tgtgtgcacagtgcaagacggacttcacgtgccgctggcgggaggaggagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagagaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcctaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaggctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagacttttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagcgatttggggaaaaggaaggaatttgatgttttttggggtgggaggggagggtgtgttttttacaccaaaaaaaaaaaaaaaaaa

SEQ ID NO: 1694 - DNA, 1903 bp, Homo sapiens
aataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctcagttcctaaaggcttaccaccaactttattggagcttcacttagattataataaaatttcaacagtggaacttgaggattttaaacgatacaaagaactacaaaggctgggcctaggaaacaacaaaatcacagatatcgaaaatgggagtcttgctaacataccacgtgtgagagaaatacatttggaaaacaataaactaaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcacattttaaaaagagctgtactgtaaatggaatgcttgacttagcaaaatttgtgctctttcatttgctgttagaaaaacagaattaacaaagacagtaatgtgaagagtgcattacactattcttattctttagtagcttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcataaaatctgtaactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaaaaaaaaaaaaaaaaa

SEQ ID NO: 1695 - DNA, 2780 bp, Homo sapiens
tttttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacaccacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagctcgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaagaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaaaaaaaaaaaaaa

SEQ ID NO: 1696 - DNA, 1807 bp, Homo sapiens
cttggcagcctgccttacagggtagcccaccttatagggtagccctcatatctgccctatgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaatttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaaaaaaaaaaaaaa

SEQ ID NO: 1697 - DNA, 869 bp, Homo sapiens
agatgcgaggcggcggtcagcaggtgccgaacccacggccaggcttccgtggccagcagccctagaggaatggccatcctgtccctgcgagcccctgggccctggcaggcgatgcaggtgggatgctatggaatatgatgagaagctggcccgtttccggcaggcccacctcaaccccttcaacaagcagtctgggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacaggtgggccgagacccagacgaggagtgaggaatgagagagaccaaagttcctgcctccgctgggctcacattcagatgtgagctatccagtgtggtggccactagccaaacatggccagtcaaagttaaattaactaaatatgcatttcctcgttgtactgtctacattggacagggctgttctggatgagaaattaaactagtgaattacaaaaaaaaaaaaaaaaaa

SEQ ID NO: 1698 - DNA, 2076 bp, Homo sapiens
tctctcactcggtgccgctgcctaggggctgtagaggtcgcgccgctcctgctggggcctgcccacgccaaggacctgcctctgtcgcctcctcttctattgcccagtttccccagccagaacatcccctgaagatggcagaggagagcagctgtaccagggattgcatgtccttcagcgtgctcaactgggatcaggttagccggctgcatgaggtcctcactgaagttgtacctatccacggacgaggcaactttccaaccttggagataactctgaaggacatcgtccagaccgtccgcagtcggctggaggaggcaggcatcaaagtgcacgacgtccggctgaatggctccgcagctggccacgttttggtcaaagataatggcttgggctgcaaagacctggacctaatcttccatgtggctcttccaacagaggcagaatttcagctggttagagatgtggttctgtgttcccttctgaacttcctgccagagggtgtgaacaagctcaaaatcagtccagtcactctgaaggaggcatatgtgcagaagctagtgaaggtttgcacggacactgtccgctggagcctgatctccctctccaacaagaacgggaagaacgtggagctgaagtttgtcgactccattcggcgtcagtttgagttcagtgtggactctttccaaatcatcctggattctttgcttttcttctatgactgttccaataatcccatctctgagcacttccaccccaccgtgattggggagagcatgtacggggactttgaggaagcttttgaccatctgcagaacagactgatcgccaccaagaacccagaagaaatcagaggcgggggacttctcaagtacagcaaccttcttgtgcgggacttcaggcccacagaccaggaagaaatcaaaactctagagcgctacatgtgctccaggttcttcatcgacttcccggacatccttgaacagcagaggaagttggagacttaccttcaaaaccacttcgctgaagaagagagaagcaagtacgactacctcatgatccttcgcagggtggtgaacgagagcaccgtgtgtctcatggggcatgaacgcaggcagactctgaacctcatctccctcctggccttgcgtgtgctggcggaacaaaacatcatccccagtgccaccaacgtcacctgttactaccagccggccccttacgtcagtgatggcaacttcagcaactactacgttgcccatcctccagtcacctacagccagccttaccctacctggctgccctgtaactaaccttgagacctgagggtttccacagtgggaaccccaatagggctagggctctcaggtaggggagcctccttctagatgtaggcatttggcttttaaaggggaactcagctctgattctgcttttttttttttttttcctttgtgtacccattggaatgggtctacagtgtatcatgagccaaccctcaaaggacccgtattacagtgccacgttggaaaacgctacaggaagcatgacctatccacatctttccaagatagacactaacatgtcatgtcccaaacattagcacgtgggggttgagctctgtgcagtaatcgagattgggagaatttgggcagcgcgtgagaagtgctaagctacttgttttctcacttgagcccgggtaggctgtgttggccctcacttgggattctcagcagttacatgaaagttgtgctgataatctcttctcttgtaccaattttagtcaggcagaaaatggtaaacatgagggtgctcttgtgacttaatttttgttcaagggactaaattgcttatgtttattccctgtcagcggagtggagaatgtcattcatcaataaaccaaagccaatagctggagaattgagatctggttgaaagtggtttatggtttacatgctgtactatcctgaggaattgcgagatattgctgaggggaaaaaaaaatgaccttttcttgaaatgtaacttgaaaacaaaataaaatgtggaacataaaaaaaaaaaaaaaaaaaaaaaaaa

SEQ ID NO: 1699 - DNA, 1934 bp, Homo sapiens
agctgctgccactgctcagcgcggtgaggagggagccggtgactcggagacggtgactcagaggcagagcggcgcaagggccaaggagtactggcgtccatggaccctggggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggcctctgagctgtgggaggtggtggaggagcctcgggtcaggctggggacagagggtgtcatgcctgagaggcaggaaggtcacctgctcaagaagaggaagtggcctctgaagggctggcacaagagatactttgtgctcgaggacgggatccttcattatgcaacaacccggcaagacatcaccaaggggaagctccatggctccatcgatgtccggctgtcggtcatgtccatcaacaaaaaggcccagcgcattgaccttgacactgaagacaacatctaccacctcaagatcaaatcccaggacctattccagagctgggtggcgcagctgcgtgcccaccgcctagcccaccgcctggacatgccccgtggctcactgcccagtactgctcaccggaaggttcctggtgcccagcttccaacagcagctactgcctcagccctacctgggcttggaccgcgggagaaagtgtcttcctggctgagggacagtgatgggctggaccgctgctctcatgagctctctgagtgtcaggggaagctccaggaactacacaggctcctccagagcctggagtccctgcaccgaatcccctcagcccctgttatccccacacaccaggcctcagtgacaaccgaaagacccaagaaggggaaacggacaagccgcatgtggtgcacccagagctttgccaaggatgacaccattggacgggttggtcgtctccatggctctgttcccaacctgtctcgctacctggagtctcgggactcctcgggcacccgtgggctgccacccacagactatgcccacctgcagcgcagcttctgggccctggcccagaaggtgcacagctccctcagcagcgtcctggccgccctcaccatggaacgggaccaactgagggacatgcaccagggctcagagttgtcaagaatgggggtctctgaggcctccactggccagaggcgcctccactcactgtccacctcctccgacaccacggcggactctttcagctccctcaaccctgaggagcaagaagctctgtacatgaaggggcgcgagctcaccccccagctatcgcagaccagcatcctgtcccttgctgattcccacacggagttcttcgatgccagcgaggttctcctctccgccagctcttctgagaatgagggctcagaggaggaggagtcctgtaccagtgaaatcaccaccagcctgtctgaggagatgctggacctcaggggagctgagcgctgtcagaaaggggggtgtgttccagggagacccatggggccaccccgccgtcgctgcctgccggcggccagcgggcctggggctgacgtgagcctgtggaacattctgcgcaacaacatcggcaaagacctgtccaaggtgtcaatgcctgtgcagctcaacgagccgctcaacactctgcagcggctctgcgaggagctggagtacagcagcctcctggaccaggccagccgcatcgccgacccctgcgagcgcatggtgtacgtcgcagcctttgctgtctcggcctactcctccacataccaccgagccggctgcaagcccttctccctgcactcaataaaccctcaataaatattctcattgtcaatcagaaaaaaaaaaaaaaaaaaaaa

SEQ ID NO: 1700 - DNA, 2216 bp, Homo sapiens
actacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccggcaagtatctcccaactgggggctgccttcaatcctcagaccaggaacacccatgacacaggcacagccctgcactgtgggcgtgccccttggcatggggccaggagatcactgggttatcccggttagtgatgccctcacctctccccacaagttgtttacccaatggctggaaaggggtggctactggtcatcgtgaccactggagtcaacacagactgatgtacccacagacaccaaaacttgccccctgagttctgaagcaaggggcaaggctgggcccctagcttgtcctgcccattcctccaggtgttgatcttgattccacttagagaagctgaagctgtgcctccctcccctgtcaagccagttctttcctcttcaggtggctgttctggcccagccccttcccatccccaaggagcccttcagcgcgccctgttgcttctgctagcctacctttccctgccaggcccttgctcagggccatggcatttaactaagtgcacctgtgatcttggccaaaaaaccattgcaactcacagtaagagactgggtttcggggaaggaggggctagggacattttggcactggcctgccctattgtctcccatcctagtctgtcctggtccctggcaacaggaacctgggcagcttatcctgcccacaggtaagcccctgggagcatccacaactggggacctgctcagtgccccccctgccttacagctacatgacagtgctgttttatttgaacaacgtcactggtgggggcgagactgttttccctgtagcagataacagaacctacgatgaaatgagtctgattcaggatgacgtggacctccgtgacacacagaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgaaaaaaaaaaaaaaaaa

SEQ ID NO: 1701 - DNA, 2039 bp, Homo sapiens
ccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatataaaaaaaaaaaaaaaaaaaaaaaaaa

SEQ ID NO: 1702 - DNA, 2197 bp, Homo sapiens
attacatgtgtctgtctggcctgatctgtgcatctgctcggagacgctcctgacaagtcgggaatttctctatttctccactggtgcaaagagcggatttctccctgcttctcttctgtcacccccgctcctctcccccaggaggctccttgatttatggtagctttggacttgcttccccgtctgactgtccttgacttctagaatggaagaagctgagctggtgaagggaagactccaggccatcacagataaaagaaaaatacaggaagaaatctcacagaagcgtctgaaaatagaggaagacaaactaaagcaccagcatttgaagaaaaaggccttgagggagaaatggcttctagatggaatcagcagcggaaaagaacaggaagagatgaagaagcaaaatcaacaagaccagcaccagatccaggttctagaacaaagtatcctcaggcttgagaaagagatccaagatcttgaaaaagctgaactgcaaatctcaacgaaggaagaggccattttaaagaaactaaagtcaattgagcggacaacagaagacattataagatctgtgaaagtggaaagagaagaaagagcagaagagtcaattgaggacatctatgctaatatccctgaccttccaaagtcctacataccttctaggttaaggaaggagataaatgaagaaaaagaagatgatgaacaaaataggaaagctctatatgccatggaaattaaagttgaaaaagacttgaagactggagaaagtacagttctgtcttcaatacctctgccatcagatgactttaaaggtacaggaataaaagtttatgatgatgggcaaaagtcagtgtatgcagtaagttctaatcacagtgcagcatacaatggcaccgatggcctggcaccagttgaagtagaggaacttctaagacaagcatcagagagaaactctaaatccccaacagagtatcatgagcctgtatatgccaatcccttttacaggcctacaaccccacagagagaaacggtgacccctggaccaaactttcaagaaaggataaagattaaaactaatggactgggtattggtgtaaatgaatccatacacaatatgggcaatggtctttcagaggaaaggggaaacaacttcaatcacatcagtcccattccgccagtgcctcatccccgatcagtgattcaacaagcagaagagaagcttcacaccccgcaaaaaaggctaatgactccttgggaagaatcgaatgtcatgcaggacaaagatgcaccctctccaaagccaaggctgagccccagagagacaatatttgggaaatctgaacaccagaattcttcacccacttgtcaggaggacgaggaagatgtcagatataatatcgttcattccctgcctccagacataaatgatacagaaccggtgacaatgattttcatggggtatcagcaggcagaagacagtgaagaagataagaagtttctgacaggatatgatgggatcatccatgctgagctggttgtgattgatgatgaggaggaggaggatgaaggagaagcagagaaaccgtcctaccaccccatagctccccatagtcaggtgtaccagccagccaaaccaacaccacttcctagaaaaagatcagaagctagtcctcatgaaaacacaaatcataaatccccccacaaaaattccatatctctgaaagagcaagaagaaagcttaggcagccctgtccaccattccccatttgatgctcagacaactggagatgggactgaggatccatccttaacagctttaaggatgagaatggcaaagctgggaaaaaaggtgatctaagagttgtaccacctatataaacatcctttgaagaagaaactaagaagcatttgcaaatttctcttctggatattttgtttatttttttcttaagtccaaaaattatcattacagtgtaccatattaagccatgtgaataagtagtagtcattatttgtgaaaaattcccaaaagctggggaaaacaatgtgtaacttttccagttacttgacacgattcagtgggggaaaaccagcattttttattctattgataccaagcatttctaataagagcttgttaaatttaagaataaagttatttaaaataaaaaaaaaaaaaaaaaaaaaaaaaaaa

SEQ ID NO: 1703 - DNA, 3043 bp, Homo sapiens
ttttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtgaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcgtctcttactgaatttaacactgtctgatatcatggtctccctggcaaatgcgtcaaccttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgctttaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaaaaaaaaaaaaaaaaaaaa

SEQ ID NO: 1704 - DNA, 2426 bp, Homo sapiens
atataaagctggttaaggtggtatccagtggagcccctcatgccatcctgttgaaattcctcccattgcccgtggttcagctcctcgacaggtgtgggctgctgacgcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcatggttttggttgccactccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatctagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaaaaaaaaaaaaaaaaaaaaaaaaaaaaaa

SEQ ID NO: 1705 - DNA, 2129 bp, Homo sapiens
ctgtattgagacaaaggaagggatctgtcagaaagcaacacttgttatcttgggcttggcagcaaggaagaggacaggtagtggagatcctgcaatctgaaaagcagactgaaaggtgacaaagaagctgaagatgggtggtggagagaggtataacattccagcccctcaatctagaaatgttagtaagaaccaacaacagcttaacagacagaagaccaaggaacagaattcccagatgaagattgttcataagaaaaaagaaagaggacatggttataactcatcagcagctgcctggcaggccatgcaaaatggggggaagaacaaaaattttccaaataatcaaagttggaattctagcttatcaggtcccaggttactttttaaatctcaagctaatcagaactatgctggtgccaaatttagtgagccgccatcaccaagtgttcttcccaaaccaccaagccactgggtccctgtttcctttaatccttcagataaggaaataatgacatttcaacttaaaaccttacttaaagtacaggtataaaataagacaaatgtttaaatttagttatgttcacgggtagttgtcaattggtctgaaacaaatttgctagggaatctatttgtgtagaactaattaatgtaaaaaaaatagaccatctcgtgttgtgtgcactgtgatataatggtagtatcagtgcaacttaaactaatgattgtacttgatattaagtgttctcaactgagtaacttttaagtggaaaccaagtttagatttggggagtggtaaaggaatcagctttttctattgttaggggaagacagtaatttatcattcatggaccagtagattgttgaaagttggtgaatcggattataagcttctagctaacacaaggattcagaattaggtaaacatctgaaggtttagtatattagaaacacccaaaccagtaatatgctaacctgatgcactgctgaaagaaaatgtgaatttttcgtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctggcctcatcattcctgcaaagcttgctttggggagttggataatgtgaaaattttaagtacctaggggagaaagagccatgtaaatatctgtaataaacttgtagcatatgtaaagttttcttggcctttatcttacaaaaatggagtattttagtatgaatttgctgaatgtaagaccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctctaagcccaaagattaactagagtccctccaaccttatagattgttggctttcacaatcttataacctaggatacaggtagtttcgagtatggtgccagtgatgttttgtttttgtttggtcaaggggtaggtgcaacccaatggaccacttatgcaaaagatgtaaactcttgcataatacattgataacatgttttgccaactttaaatgcttaaacataagcgaaaccagtagcaagtatgtgggtcagcttaaaaattttgattgttaatgccctattttctaatttggcacctcttgatgcctaagcaggtaagcagatgcctaagctgtatttctccaaataaatcaagatgaagtactgcccaagttaaatattgatagcctaaagacaagtttatgtagtacttaatgtacatgatatgaagcataaaattaaataaaatttttccccattgaaaaaaaaaaaaaaaaa

SEQ ID NO: 1706 - DNA, 3802 bp, Homo sapiens
aaaaaaaaaaaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctgttatcagagtgatccccttgaaaatggaccccacaggaaaactgaatctcactttggaaggtgtgtttgctggtgttgctgaaataactccagcagaaggaaaattaatgcagtcccacccactgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcgtgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggaatgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccggatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaaaaaaaaaaaaaaaaa

SEQ ID NO: 1707 - DNA, 2340 bp, Homo sapiens
gatagcgccgggcagagggacccggctaccctggacagcgcatcgccgcccgcccgggtcgccgcgccacagccgctgcggatcatggaacatctaaaggcctttgatgatgaaatcaatgcttttttggacaatatgtttggaccgcgagattctcgagtcagagggtggttcacgttggactcttaccttcctaccttttttcttactgtcatgtatctgctctcaatatggctgggtaacaagtatatgaagaacagacctgctctttctctcaggggtatcctcaccttgtataatcttggaatcacacttctctccgcgtacatgctggcagagctcattctctccacttgggaaggaggctacaacttacagtgtcaagatcttaccagcgcaggggaagctgacatccgggtagccaaggtgctttggtggtactatttctccaaatcagtagagttcctggacacaattttcttcgttttgcggaaaaaaacgagtcagattacttttcttcatgtatatcatcatgcttctatgtttaacatctggtggtgtgtcttgaactggataccttgtggacaaagtttctttggaccaacactgaacagttttgtccacattcttatgtactcctactatggactttctgtgtttccatctatgcacaagtatctttggtggaagaaatatctcacacaggctcagctggtgcagttcgtgctcaccatcacgcacaccatgagcgccgtcgtgaaaccgtgtggcttccccttcggttgtctcatcttccagtcatcttatatgctaacgttagtcatcctcttcttaaatttttatgttcagacataccgaaaaaagccaatgaagaaagatatgcaagagccacctgcagggaaagaagtgaagaatggtttttccaaagcctacttcactgcagcaaatggagtgatgaacaagaaagcacaataaaaatgagtaacagaaaaagcacatatactagcctaacagattggcttgttttaaagcaaagactgaattgaaggttacatgttttaggataaactaatttcttttgagttcataaatcatttgtacccagaatgtattaatatattgctattaggttaatctgttaactgaatgctttgatcagcattgaggtgatgctcacctccgaggacctcagaactggtgcagcttctctctccctccctcccacagactgaacctttcgccagaagctgtccttataacgccttatacgcatacacagccaggaaacgtggagcattgtttctcacagagagtctccaaataaaaagggttttgttcagattaaaatgtttacaacaaaatgttaattatattctaaatacagggtatgttctaatctatattaagcaataatgccagtgcataatcattccatttgttcctttagcaatcaaccccagaaaatattaaaatgggatcatacacagaagatagaaaaatctagcaaaacttctctttctgtaagccagagtcttgtctatcagattcccacaaccactcctgattctaaatttagtgatatggtaatgaaattggtatttattttaaatattagttattctaaggagaaaaaaatgcttctgcaagattttcataattcaggggctgtggataggattgttcctctgtttccctaatcattcatctgttcatgtctccctcttgtgccagtcagcctaggttatacagatgccatgctccacaccacgagcagtgtacaaatctggctgcccgtttactttctgagcaagcactggagtccactccgacctttttctttgaacatgcatgctgctggaatatgtataaatcagaactagcagaagtagcagagtgatgggagcaaaataggcactgaattcgtcaactcttttttgtgagcctacttgtgaatattacctcagatacctgttgtcactcttcacaggttatttaagttcttgaagctgggaggaaaaagatggagtagcttggaaagattccagcactgagccgtgagccggtcatgagccacgataaaaaatgccagtttggcaaactcagcactcctgttccctgctcaggtatatgcgatctctactgagaagcaagcacaaaagtagaccaaagtattaatgagtatttcctttctccataagtgcaggactgttactcactactaaactctaccaagaatggaaaccaagaatattttctgaagatttttttgaagattaatttataccctataaaataaaacttgttagcttcgatgaagtcaaaaaaaaaaaaaaaaaaaaa

SEQ ID NO: 1708 - DNA, 2396 bp, Homo sapiens
gtgccgagactcaccactgccgcggccgctgggcctgagtgtcgccttcgccgccatggacgccaccgggcgctgacagacctatggagagtcagggtgtgcctcccgggccttatcgggccaccaagctgtggaatgaagttaccacatcttttcgagcaggaatgcctctaagaaaacacagacaacactttaaaaaatatggcaattgtttcacagcaggagaagcagtggattggctttatgacctattaagaaataatagcaattttggtcctgaagttacaaggcaacagactatccaactgttgaggaaatttcttaagaatcatgtaattgaagatatcaaagggaggtggggatcagaaaatgttgatgataacaaccagctcttcagatttcctgcaacttcgccacttaaaactctaccacgaaggtatccagaattgagaaaaaacaacatagagaacttttccaaagataaagatagcatttttaaattacgaaacttatctcgtagaactcctaaaaggcatggattacatttatctcaggaaaatggcgagaaaataaagcatgaaataatcaatgaagatcaagaaaatgcaattgataatagagaactaagccaggaagatgttgaagaagtttggagatatgttattctgatctacctgcaaaccattttaggtgtgccatccctagaagaagtcataaatccaaaacaagtaattccccaatatataatgtacaacatggccaatacaagtaaacgtggagtagttatactacaaaacaaatcagatgacctccctcactgggtattatctgccatgaagtgcctagcaaattggccaagaagcaatgatatgaatgatccaacttatgttggatttgaacgagatgtattcagaacaatcgcagattattttctagatctccctgaacctctacttacttttgaatattacgaattatttgtaaacattttggttgtttgtggctacatcacagtttcagatagatccagtgggatacataaaattcaagatgatccacagtcttcaaaattccttcacttaaacaatttgaattccttcaaatcaactgagtgccttcttctcagtctgcttcatagagaaaaaaacaaagaagaatcagattctactgagagactacagataagcaatccaggatttcaagaaagatgtgctaagaaaatgcagctagttaatttaagaaacagaagagtgagtgctaatgacataatgggaggaagttgtcataatttaatagggttaagtaatatgcatgatctatcctctaacagcaaaccaaggtgctgttctttggaaggaattgtagatgtgccagggaattcaagtaaagaggcatccagtgtctttcatcaatcttttccgaacatagaaggacaaaataataaactgtttttagagtctaagcccaaacaggaattcctgttgaatcttcattcagaggaaaatattcaaaagccattcagtgctggttttaagagaacctctactttgactgttcaagaccaagaggagttgtgtaatgggaaatgcaagtcaaaacagctttgtaggtctcagagtttgcttttaagaagtagtacaagaaggaatagttatatcaatacaccagtggctgaaattatcatgaaaccaaatgttggacaaggcagcacaagtgtgcaaacagctatggaaagtgaactcggagagtctagtgccacaatcaataaaagactctgcaaaagtacaatagaactttcagaaaattctttacttccagcttcttctatgttgactggcacacaaagcttgctgcaacctcatttagagagggttgccatcgatgctctacagttatgttgtttgttacttcccccaccaaatcgtagaaagcttcaacttttaatgcgtatgatttcccgaatgagtcaaaatgttgatatgcccaaacttcatgatgcaatgggtacgaggtcactgatgatacataccttttctcgatgtgtgttatgctgtgctgaagaagtggatcttgatgagcttcttgctggaagattagtttctttcttaatggatcatcatcaggaaattcttcaagtaccctcttacttactagactgctagtggataataacatcttgactacttaaaaaagggacatattgaaaatcctggagatggactatttgctcctttgcctaacttactcatactgtaagcagattagtgctcaggagtttgatgagcaaaaagtttctacctctcaagctgcaattgctagaactctttagaaaatattattaaaatacaggagtttaccttaaaggaaaaaaaaaaaacaaaaaaaaaaaaaaaaaa

SEQ ID NO: 1709 - DNA, 3082 bp, Homo sapiens
catttgccttctcgttttggcctaaggatagagtaatgataaaccgcttagacaacatctgtgaagcagtgttgaaaggcaaatggccagtaaataggcgccagatgtttgatttccaaggcctcatcccaggttacacacccaccacagtggacagccccttgcagaagaggagctttgctgagctctccatggtcggccaagccagcattagtgggagtgaggacatcactacgtctcctcagttgtcaaaggaagatgccctcaacctctctgtccctcgccagcggaggaggaggaggagaaaaatcgaaattgaggccgaaagagctgccaagaggcgaaatctcatggagatggttgcccagcttcgagagtctcaggtggtctcagaaaatggacaagaaaaagttgtagatttatcaaaggcctcaagagaggcaacaagctctacctcaaatttttcatctctttcttcaaagtttatcttgcctaatgtctcaacaccagtgtctgatgcctttaagactcaaatggaactgctccaagcaggcctttcgcgcacacccacaaggcatctccttaatggctccctagtggatggagagcctcccatgaagaggaggcggggaaggaggaaaaatgtggagggacttgatctgcttttcatgagccacaaacggacgtcattgagtgcagaggatgctgaggtgaccaaagcttttgaagaagatatagagaccccaccaacaagaaacattccttctcccggacagctggacccagacacacggatccctgttatcaatcttgaagatgggactaggctggtgggggaagatgctcctaaaaataaggatttagttgaatggctgaagctgcaccctacttacactgttgatatgccaagttatgtaccaaagaatgcagatgtgctgttttcctcatttcagaaaccgaaacagaaacgacatagatgtcgaaaccctaataaattggatataaacactttgacaggagaagaaagggtgcctgttgtcaataaacgaaatgggaagaagatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctctgaaaactgctatcatgtaagataaaatgtaaattgctgccaactgtagtaatgatgcttttaataaaagtgacccatgatatgcagagatgtaaaaaaaaaaaaaaaaaaaaaaaaaaa

SEQ ID NO: 1710 - DNA, 3041 bp, Homo sapiens
caatgctacattaacccattatgtaagaccaataaatgcagagccagcgtttcaagcacaggaaataccagcaggcagaatggccagtttgcttaagaatggtgagcctgaagctgagttacataaagaaaccacaggtccaggcactgctggccctcagtccaacaccacatcttctctaaaaggtgaacgcaaagccatccacacgctgcaagatgtgtcaacatgtgaaacaaaggagctattgaatgtcggggtttcctccctttgtgctggtccctaccaaaatacagcagacaccaaggaaaacctcagtaaagagcctttggcctcctttgtttcagaatcctttgatacttctgtttgtggaatagccacagagcacgtagaaattgagaacagtggggaggggctcagggctgaggctggttctgaaaccctaggcagagatggagaggtcggtgtgaattccgacatgcactatgaactctctggagattctgatctagacctgcttggtgattgtagaaatcccagactggatttggaggattcttatactttaagaggtagttacaccaggaaaaaagatgttcccacagatggctatgagtcgtcgttgaacttccacaacaacaaccaagaggactggggctgctctagccgggttccaggcatggagacgagcctccctcccgggcactggactgctgcggtaaagaaagaagagaagtgtgtgccgccttacgtccaaatccgagatctccacgggatcctcaggacttacgccaacttctctataacaaaagaactcaaagataccatgagaacttcacacggcctgaggaggcacccgagtttcagtgcaaactgtggcctgcccagctcctggacaagcacttggcaggtggcagacgacctcacccagaacactttagacctggagtatctgcgttttgcacataaactaaaacagaccataaagaatggggattctcagcattctgcctcctctgccaatgtctttccaaaggagtcaccaacccagatctccattggtgctttcccttcgacaaaaatctctgaggccccatttctgcatcctgcacctaggagcagaagcccccttctggtaacagctgtggagtcagatcccagaccacagggacagcccaggagaggctacacagccagcagtctggacatctcttcctcttggagagagagatgtagtcataatagagatcttagaaattctcaaagaaatcacactgtttcattccacctcaacaaactgaaatacaacagtactgtgaaggaatctcggaatgatatttcacttattctcaatgagtatgctgaattcaacaaggtgatgaagaatagcaaccaattcattttccaagacaaagagctaaatgatgtttctggagaagccactgctcaagagatgtatctgcctttcccaggacggtcagcctcctatgaagacataatcatagacgtgtgcaccaatttgcacgtcaaactaagaagtgttgtgaaagaggcttgtaaaagtaccttcctgttctaccttgtcgaaacagaagacaaatcattctttgtaagaacaaagaaccttctgaggaaaggaggccatacagaaattgaacctcagcacttctgtcaagctttccacagagagaatgatacactaatcatcatcatcagaaatgaagatatatcatcacatttgcatcagattccttctttgctgaagctgaagcatttccccagtgtcatctttgctggagtagacagccctggagatgttcttgatcacacctaccaagaactgtttcgtgcaggaggctttgtgatatcagatgacaagatactagaagctgtaacattagttcaactgaaggaaattatcaaaatcctggaaaaactaaatggaaatggaagatggaagtggttgcttcactacagggaaaataaaaagctaaaagaagatgaaagagtggattcaactgcacataagaagaacataatgttgaagtcatttcagagtgcaaatatcattgaattgcttcattatcaccagtgtgactctcgatcatcaacaaaagcagaaattctgaaatgtttgctaaacctgcaaattcagcatattgatgccaggtttgctgtcctcctaacagacaagcctactatccccagagaagtctttgaaaatagtggaatccttgttacagatgtaaataactttatagaaaacatagaaaaaatagcagctccatttaggagtagctattggtgactcaactacagcctgcctggatatggatgatgccaataaaaaattagtattttccctttggaaaacttgtgaacatgtgaatacacatgtgaagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacgaatagctttgtttttgctatgctaatgtctagaaaggcatacgatgctactattatgctctgttttaaaggttttacctacccttgtaaaaactataatcttaaatggttttatttgctgtttactacttatacatactactactataaaactattttttcctaaatggtacaaatttataaactatcatttttcacttacggtatttgtaaatactactactacaaaaatcagctttccgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaactaaaaataaaaaaaaaaaaaaaaaa

SEQ ID NO: 1711 - DNA, 2774 bp, Homo sapiens
ttttttgtcctcagccccagcagccgcccggctggctgcagaggccgaggggccgagggcaccggagcgcaagggattccgcggcaccacgtgtccaagccgggctaaggcgggcggagcgggccgggcccggctccccgggcctgagcgcaaaccagcagcgacgcggggtcccgtccgcaccggcacccggcccagccggggcccggtctcccgggcgcacgtaggctcctcctcctggacagcgcgatggggcccttctgggcgagaaaggatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacaggtttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaagtcttaaatggcttgtttgttcttaaactgttaattgatgaaactgtgcataagtttacatgtactaacttattttgcttattatatatagtgttttattggaaattgtaaccacacacttcagcatgatgaaaataaagattagtgtttccatttaaataaatgttttatcctcccataaaaaaaaaaaaaaaaaaa

SEQ ID NO: 1712 - DNA, 3614 bp, Homo sapiens
aaggagagaacttttcctgcacaaggaacgcctcgtggggagacccaaggcaggagcggtccggagccggctgcggcgtgtgcggccggccttgggacagcgatcgccgcgggtggcaacagagagccccaagcaaaagtgggagcaggagcttggaggtgagcacaggaagccccacttgaggcttttacgcagcctctagtctctgtttcttctggaataggcaagcgtcctttcaactctaagagaccagcagaggccactgtcccttaagactgccggagtcctcaccacttctccaggattccagaggagactgtggcgatggtgaatgaaggtcccaaccaggaagagagcgatgacacccctgcgccggagtccgcactccaagcggaccccagcgtctcggtccatcccagcgtctcggtccatcccagcgtctccatcaaccccagcgtctctgtccaccccagcagttcggcccaccccagtgccttagcccaacccagtggcttggctcaccccagtagctcgggccctgaggacctcagcgtgatcaaggtgagcaggcgccgttgggccgtggtcctggtgtttagctgctactccatgtgcaactcctttcagtggatccagtacggctccatcaataacatcttcatgcacttctacggtgtcagtgcctttgccattgactggctgtccatgtgctacatgctgacttacatccctctgctcctgccagtggcttggctgctggagaagttcggcctgcgcaccattgctctcactggctcggctctcaactgcctgggggcctgggtgaagctgggcagcctgaagccgcatctctttccggtcaccgtagtgggccagctcatctgctctgtggcccaggttttcatcctgggcatgccctcccgcatcgcttccgtctggttcggggctaatgaggtttcaacagcctgctcggtggctgtctttggcaatcagcttggaattgcgattgggttcttggtccctcctgttttggtacccaacattgaagaccgggacgagcttgcctaccacatcagcatcatgttctatataataggaggtgtggccactctcctcctcatccttgtcatcattgtgttcaaggagaaacctaaatatccccccagcagggcccaatccctgagctatgccttgacctctcctgatgcctcatacttaggttccatcgcccggctcttcaaaaatctcaactttgtgctgcttgtcatcacctatggtctgaatgctggtgctttttatgccttgtccactcttctgaatcgcatggtgatctggcactacccgggggaagaagtgaatgctggaagaattggcctgacgatcgtcattgcaggaatgcttggggctgtgatctcaggaatctggctggataggtccaaaacctacaaagagacaaccctggtagtctatatcatgacactggtgggcatggtggtgtacacgtttaccttgaacctgggacacctgtgggtagtgttcatcactgctggcacaatgggcttctttatgactggctatctcccactgggatttgagtttgctgtggagctcacgtacccagaatcagaaggcatctccttcggcctcctcaacatatctgcacaggtatttgggatcatctttaccatctcccagggccagattattgacaactatggaaccaagcctgggaacatcttcctgtgtgtgttccttactcttggagcagccctcactgcattcattaaggcagatctccggagacagaaagcaaacaaagaaactcttgagaacaaactccaagaggaggaggaggagagcaacaccagcaaagtgcccactgctgtgtcagaggatcatctctgagaggaaggtggtgacaactcagggaacacgaacaccccaccttttccttcagcacagctctcaccgccagcacaaagggcttcgctagagatgtttttggagggaatcagtgggactatttgtggcatggatggcctattcctcctagaacccacgtaagagcttggatgatttagttggagaaaattgcacctatcaccaaatgcaaatttgattcccacctccacccccttttaggttatgggagttggtgttgggacagggtggcagagaatattggagtcaatcctagcttggtctcttgccttccctcttttcctccatccatcgtggacaatgcctgcaaaattttcacaggaagaaagcctattcaggatattaacttgaaatttccagtgtcctaagagcctctcatgaagcccagttctaataagtggcaagctgctctgccggggtcatctcctgggtcatcggactgattgctcaagttctgcaggagaggaagcaccattagaacaactccatcagaacagctccaccgggacttgtgggcctaaattttcctggcctaacgggtctgtctccaaaccctctttcctaagagctgagcaaaccaaccataataaacttgacaaaagactttgttgtggccatgacagagataccgactcaggagggctacctacctaggtgtgatcatgctgggggctaccttctgagtatatttgtgaaagcacatatttgggaactctggtagcttgagttgggaatgggaaggttcttttttacagaagtacttccccagggacttctgtgtgtcacagtcacctctgatgcctttatcttgatgttgcattgggaatctcagccatcagcccaagtgcttgttttattccaaggcagggtaatccccgtcaacttactctaacctttgctgaaaactaatcttgattcattctactctgaaaatccaaaggtgcttctgagagataagagggaaggggtagaaggaaaggtgccccttgaaatgggaattgagcctgttagaattaaaagcttatctcacctctgctggggacagtatttgcaccaccaacccctctcctcacctgctttgagcgataatctttatcagatattctaaacttaaagggattccctttaaaccaactcaagctgatctttcctatctagcctgctgtttggctgtactcatgggctttggtaatatctcctaaaaatgaggttttggtaatttttcctatgcattgggcaactgtgatcgtgaccactgtgctgtcttgctccagccactgccctggcctcagcatatcagggcagcctgtgctggctgcaatactgtggtgcttgggccactgcctgagaggagccaggtttgtgtgtgtctgcatgtgtgtgtgtgtgtgtttgtacagattcaagcaatggatgcaaggaacatgctgtatgtaatagaagaaagaagtccacgttttcggcagaagtagtgagtcagtgtggaagagaggtgagggtgtgctttactttttgataaagagaaagatgtttactcataaacccttcaaaaggtattaacaaatgtttaccaaacctattgctttattttaaaaacataatttgtgttttctatttgtaagatctgacatttcgaggccaataaaaacttctcagaaaaaaaaaaaaaaaaa

SEQ ID NO: 1713 - DNA, 1457 bp, Homo sapiens
agccgccggctcgggagacctgccgcccctcgggcccgccacgctgctggcgctgtgcgtgcagcattccgcccgtgagctggagctgggccacctgccacgactgctgggccgcctggcccggctcatcaaggaggccgtctgggaaaagattaaggaaattggagaccgtcagccagaaaaccaccctgagggggtccccgaggtgcccctgactcctgaagctgtgtctgtggagctgcggccactcatgctgtggatggccaacaccacggagctgcttagctttgtgcaggagaaggtgctggaaatggagaaggaggctgaccaagaggacccacagctctgcaatgacttggaattatgtgatgaggccatggccctcctggatgaggtcatcatgtgtaccttccagcagtctgtctactacctcaccaagactctctattcaacgctgcctgctctcctggatagtaaccctttcacagctggtgcagagctgccggggcctggcgcggagctgggggccatgcctccaggattgagacctaccctgggcgtgttccaggcagccttggagctgaccagccagtgcgagctgcaccctgacctcgtgtctcagacttttggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggcttcatggagcagcctaagaaccgaccaccccaccttgacccccgcccagctgcaccatctgctcagccactatcagctgggccctggccgcgggccgccagccgcgtgggaccctccccctgcagagcgggaggctgtggacacaggggacatcttcgaaagcttctcctcgcacccgcccctcatcctccccctggggagctcgcgcctgcgcctcactggtccagtgacggacgatgccttgcaccgtgaactccgtaggctccgccgcctcctctgggatcttgagcagcaggagctgccagccaattatcgccatgggcctcccgtggccacgtctccttgagaaccaataccaaacgagcgcgcgaaccttgaaatgtcacgggcttctacggacaggagcccgcctgagcgcaaagctttctgggagttgtagttcttatcccgcgtggaatgttgggagattgagttttcgggaagtagcggatgggacggtgggagcatgggcttaggatgtgaatgccagggagcaataaaggtatccgtggtatcggcaaaaaaaaaaaaaaaaaaaaaaaaaaaaaaaaaaaaaaaaa

SEQ ID NO: 1714 - DNA, 1598 bp, Homo sapiens
agctgcggcgctgggctggcggcggcgagtccacgtgctccccgcggccggttgaaaccgttggcgggcgctggctgagaggcaatgtttgctgtcttccattggagtgactgaatttctacatgacggctttttgacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggggcgatgactataaaaaccacgtgaaatgcataagtgaagatcagaagtatggtggcaaaggctatgaaggtaaaacccacaaaggcgacatcaaacagcaggcgtggattcagaaaattagtgaattaataaagagacccaatgtcagccccaaagtgagagaacttttagagcaaattagtgcttttgacaacgttcccaggaaaaaggcaaaatttcagaattggatgaagaacagtttaaaagttcataatgaatccattctggaccaggtgtggaatatcttttctgaagcttccaacagcgaaccagtcaataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatggctctgcagggaagaggagcaagaagaagaagcagcgcaaggacagcgccagtgaggaagaggcacgcgtgggcgcagggaagaggaagcggaggcactcggaagttgaaacagattctaagaagaaaaagatgaagctcccagagcatcctgagggcggagaaccagaagacgatgaggctcctgcaaaaggtaaattcaactggaagggaactattaaagcaattctgaaacaggccccagacaatgaaataaccatcaaaaagctaaggaaaaaggttttagctcagtactacacagtgacagatgagcatcacagatccgaagaggaactcctggtcatctttaacaagaaaatcagcaagaaccctacctttaagttattaaaggacaaagtcaagcttgtgaaatgaacatttgtgtatttaaaaattgaatccattctgctgacttcttcctttcactgctgtttataaaatgtgtaatgaattctaacaactcaaattttgctttttgaagctgtatttttaagttaagaaaatatatttttggtataacttttatgagaaaaataaaatatattctggtccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1715 - DNA, 1573 bp, Homo sapiens
gagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccgaggaacatacttggagagagctaactgcttcccgcctcccgtgttcatcatctccatcagcctggccgagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctggagttcagcacatcttggggaatctttgtatgcagcttgttttgggtattcccttggaaatggtccacaaaggcctccgtgtggggctggtgtacctggcaggagtgattgcagggtcccttgccagctccatctttgacccactcagatatcttgtgggagcttcaggaggagtctatgctctgatgggaggctattttatgaatgttctggtgaattttcaagaaatgattcctgcctttggaattttcagactgctgatcatcatcctgataattgtgttggacatgggatttgctctctatagaaggttctttgttcctgaagatgggtctccggtgtcttttgcagctcacattgcaggtggatttgctggaatgtccattggctacacggtgtttagctgctttgataaagcactgctgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagaaaaggctaacaattttatatagaggacaaaacagcattaaactcatcagttgcaaagattgcctataaaaggaccttaggatttaaggaaggggcttcttaatgtagaaagggaactacaaagatgagaaattaccagaagcctcgccttttcctaagcaccagcggaaggagctgtgccccgggatggagtgagggtggagggcgcgtcagccacgggtgggccttgtgtcgcctcgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctcaaaaaaaaaaaaaaaa

SEQ ID NO: 1716 - DNA, 1245 bp, Homo sapiens
cttccgtcggtccgctcagaatcagctgtcctctcagactgtgtgggtggtttccccggccgcagctccgtacgggcttggattgctgggcctcggtgcaccccagcctcccccactcgggttctgagcttgagctggcggctctttaactctgcttcactgttgctcttggcaacatccacttccgggagcgagtgccgtttcccccgctcaccgcgggctagggagcgtgggattccggactgtgagcggctgttagtgcgtcgcagctgctggcgatccggcgaccctcggccggcaggacccgcgggccacgcagccggggccttctcaacgcctcagtacctcggcgggaccgccatggttctgctgcacgtgaagcggggcgacgagagccagttcctgctgcaggcgcctgggagtaccgagctggaggagctcacggtgcaggtggcccgggtctataatgggcggctcaaggtgcagcgcctctgctcagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaagaaacaagtggaagccggtgtctgtgttaccatggagatggtgaaagatgccttggaccagcttcgaggcgcggtgatgattgtttaccccatggggttgccaccgtatgatcccatccgcatggagtttgaaaataaggaagacttgtcgggaacacaggcagggctcaacgtcattaaagaggcagaggcgcagctgtggtgggcagccaaggagctgagaagaacgaagaagctttcagactacgtggggaagaatgaaaaaaccaaaattatcgccaagattcagcaaaggggacagggagctccagcccgagagcctattattagcagtgaggagcagaagcagctgatgctgtactatcacagaagacaagaggagctcaagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaaa

SEQ ID NO: 1717 - DNA, 831 bp, Homo sapiens
gcaaccacgggctcccaggcagcctccgccagccggaccccgtcgccctcctgatgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacgtggagtgcagtggcacaatcccagctcgctgcaacctccgcctcccgggttcaagtgattctcctgcctccgcctcccaagtagctgggattacagaagtcacctgcaccggtgcccgtgacgtacgagctgcccacactgtataggacggaggactattttcctgtggacgccggggaagcacagcaccacccccgcacctgccctcggcctttgtgagctttgtggtcttcccatcaggaacgctggaaagtgacattgtgtacacactgcagcttgggggtttttttctttgtattgctgtttattttatattttaaaaatatttaaaaaaaaaaaaaaaaaaaaaaaaaaaaaaaaaaaaaaaaaaaaaaaaaa

SEQ ID NO: 1718 - DNA, 2064 bp, Homo sapiens
ctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcatatttggttattaaaaaaaaaaaaaaaaaa

SEQ ID NO: 1719 - DNA, 1662 bp, Homo sapiens
ttgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatctctagcacattactaaaagagcctctgctttgtaaaaaaaaaaaaaaaaaaaaaaaaaaaa

SEQ ID NO: 1720 - DNA, 1554 bp, Homo sapiens
aattatatatttttactctatgtttctctacatgtttttttctttccgttgctggcggaagaggcacgtgcgctgctgaatggagctggtcgctggttgctacgagcaggtcctctttgggttcgctgtacacccggagcccaaggcttgcggcgaccacgagcaatggactcttgtggctgacttcactcaccatgctcacactgcctccttgtcagcagtagctgtaaatagtcgttttgtggtcactgggagcaaagatgaaacaattcacatttatgacatgaaaaagaagattgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagagtctgtccttgcagtggctggagatgaagaagttataaggttttttgactgtgattcactagtgtgcctctgcgaatttaaagctcatgaaaacagggtaaaggacatgttcagttttgaaattccagagcatcatgttattgtttcagcatcgagtgatggtttcatcaaaatgtggaagcttaagcaggataagaaagttcccccatctttactctgtgaaataaacactaatgccaggctgacgtgtcttggagtgtggctagacaaagtggcagacatgaaaagccttcctccagctgcagagccttctcctgtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaatttttttttttccctgagtaaaagcaagaaatttcttcctttggaaaaaatatatatattaaaaaaccacttttagatggttttttttaaaaaaaaaaaaaaaactggtaaaattacttttggcagacagtgttttatgaattatgtatcatgttgatatataatatgttaatgtgtcatgtaatttttactttgtacaaagcaaataaagatctttctcaaaaaaaaaaaaaaaaa

SEQ ID NO: 1721 - DNA, 976 bp, Homo sapiens
gaaataacagttatttatagacatggccttcccttggtaacacttaccttgccatctagaaaagaacgttgtcaattcgtagtcaaaccaatgttgtcaacagttggttcattccttcaggacctacaaaatgaagataagggtatcaaaactgcagccatcttcacagcagatggcaacatgatttcagcttctaccttgatggatattttgctaatgaatgattttaaacttgtcattaataaaatagcatatgatgtgcagtgtccaaagagagaaaaaccaagtaatgagcacactgctgagatggaacacatgaaatccttggttcacagactatttacaatcttgcatttagaagagtctcagaaaaagagagagcaccatttactggagaaaattgaccacctgaaggaacagctgcagccccttgaacaggtgaaagctggaatagaagctcattcggaagccaaaaccagtggactcctgtgggctggattggcactgctgtccattcagggtggggcactggcctggctcacgtggtgggtgtactcctgggatatcatggagccagttacatacttcatcacatttgcaaattctatggttttttttgcatactttatagtcactcgacaggattatacttactcagctgttaagagtaggcaatttcttcagttcttccacaagaaatcaaagcaacagcactttgatgtgcagcaatacaacaagttaaaagaagaccttgctaaggctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgtttaatctttgttattaaattcttgtaaaacaaaaaaaaaaaaaaaaaaa

SEQ ID NO: 1722 - DNA, 1480 bp, Homo sapiens
gctctgagtcctctactcaatacccattgagatttatgtgttctgaggcttttgtcttctagctacttacttcattctccatgggtaacgtcattcatccacattaactaatttcctcactccaagctcttttctagagataatctccagtccctgtgcagaaactgtcattgcactttctgctgaaatggcagtttcttctcagcaaggtgagattatggaatccagaatcttttttcaggggtcacatgcccatttccccacttgcatgaatgtcgacactgcagccacagttttggccgtaaatgtgaatttggcaagtaaccactgttcccagggaaatgtcccaatcagaagaagattatctgggacactgatactgacagggagatgggacattctgagggacccggaggcagggtgccacctcctcaacttccctgagggctgcctagaatctgtttcctctcactctgaattattcttcctcttatggctgaccaaaaacatggaacctcacaaagtccactgtaacagctttatatttgtgaagtgaagaacatgaagacagtttcaagcaaagttattgagtggacactttgtgttttttttgagaagtctcactctttcacccaggctggagtgcagtggcacgatctcggctcactgcaactccacctcccgggttcacgtcattctcttgcctcagcctcctgagtagctgggaccacaagcgcccaccacgtcagcttaatttttttgttttgtttcttgagacagagtcttgctctcttgcccaggttggagtgccgtgtcgcaatctcagctcactgcaacttctacctcctggattcaagcacttctccttgcctcagccacctctttagctgggattacaggtgcgtgccaccacacccagctaattaccttgtattacagcatgttatataagcacatacaggcacatacatgaaatagtgatacttcattctcagtaatatcttcatccttctcactggaaagatctttgatgatttttaatcaacataggagtttcaatgatatctagaagtttaaaagggctcgttcaaacaaattatgaccacacacactgaagagtatgtttgtctcttgtggtgtaaatttttttttattacaccaaattatgttcacacaaaacctttgtaatcagggggaattaaagagccttcctggaaaatggaggttgcaatcagccgagatggtgccatcgcactctagcctggggaatagagtgagatcctgcctcaaaaaaaacaaaaaaattctttattttctccataaactacagtttatataagcaagagtttcagtactaagcaattttagtctctgcagtctcttgtcttgaattaatacaacttttgttaattctcttatgaagttaatcttcctgcttgtatgtgaattaaatatatgtcaaactttttttgtaaaaaaa

SEQ ID NO: 1723 - DNA, 1595 bp, Homo sapiens
acagtgaatcagtgacccccaacccacggtcccctctagaagactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggtagtgcaatggccaagaggcgcttcttccagtattttgaccaactgcggcagctgcgaatgtggaaaatgcagcttctggatgaaaaccacctgtttatcaagtacactagtgaggatgtagtaacactgcgagtcacagatccatcacaggcatctttctttgtggtgtacaatatggtgacgacagaggtgattgctgtgtttgagaatacatcagatgagcttttggagctctttgagaacttctgtgacctttttcgtaatgctaccctgcacagtgaagttcagtttccctgctcagcttctagcaacaattttgcaaggcagatccagcgccggttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatactt

SEQ ID NO: 1724 - DNA, 1534 bp, Homo sapiens
tttgcgctcggggaattaaaagaggggaaaaaaagcccgaagaaaactcacgccccaaacaaaacgcaaggagaggagggcgcgcggcctgcagccctcgcccgcgtccccggccgcggcgtgatgcgcgcggaccagcccgcgacgcccgggctgccgctgtccccgcacctggacgctggcgcggtggccgcgccccagcctcgatcgctcgccgcggcgactcggccccaggcttccggcgccggtgggggccctcgctctccatggggctgagggactggctgagaaccgtgtgctgctgctgccggtgcgagtgcttggaggagcgcgccctgcctgagaaggagcccctcgtcagtgataacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggagtggcagaagctcaactatgatatccataccctgcggcaggttcgaagggaagtaagaaacagatggaagtgcatcttagaagatttaggttttcaaaaggaagctgactctttgttgtcagtgactaaactcagcaccatcagtgattctaaaaacacaaggaaagctcgagagatgttgttaaaactggctgaagaaaccagtattttcccaacaagttgggagctctcagagagatatctctttgttgtggaccgtctcattgcacttgatgctgcagaagagttctttaagcttgctcgtcgaacttaccccaagaagcctggggttccatgcctggcagatggccagaaagaactgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaacaatggaaatatttttatttttacagattttgcacttctgaattcaggttaaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgcaagataaacattcaaacagtgaaacaaacaataaaataaataaacct

SEQ ID NO: 1725 - DNA, 1564 bp, Homo sapiens
gaagcacatctggacagctgtgcggcctccttgcgggccgacgtcagccgagcacgtcccccacgtcctctccttctcgccacttattatttattcgttttcccaaagaagcgactagggacccaagtttaaaaattcctccccccactcaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgc

SEQ ID NO: 1726 - DNA, 1734 bp, Homo sapiens
attgtgggaagggcggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggcctgaggcgagcggttagagcgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacagaaagaagaacaaaaaattatcctgggcaaggggaagtccaggccaaaactgtccttctcattaaaaacccaggattaaattgcaaactctgaactttttacaaagaaaaatggaaaaactttgtatggtagcttcatgttgaagtggttttttgtttttgtttttgtttttttaatttgtaaaatctggaaagttagcttgttctaataggggctatgctctgcaattcccttttttttttttttttccttccactaagtcaaatccttatcagatcattgttgtattctaaggagtgacgtatttttcacctgtttggattctatattagtggtctgaggaagagcagatcacattgtaaaactatggatggtctgataaggcttttactgaccccactgacttcagagttatactctgcttgctacatcataatgctggttttgctgactttttgtttttttatatatttataaaaaaagaaaaagttggtgattgcattgggaaattcccagggtattactggacctatgtggtgtattgttaaaccagtgtccttgtgatactgtcgctcttgatgttcctgatacaggtaaggaaacagttggtcaactctgatacaaagtatatatacagttcagtattgtctctgttcattttgtttttatttcattgacaaaatcaaaccagcattccccattgtgtaaataaatgattttgctgaataaagtaaagtcttaaattc

SEQ ID NO: 1727 - DNA, 2398 bp, Homo sapiens
gcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagcttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttccttttttttttttcttttcctttatgttctcaccgtttgaatgcatgatctgtacggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagcactgaaaaaaaatctctatgagctaaatgtctgtctctaaagggttaaatgtatcaattggaaaggaagaaaaaaggccttgaattgacaaattaacagaaaaacagaacaagtttattctatcatttggttttaaaatatgagtgccttggatctattaaaaccacatcgatggttctttctacttgttataaacttgtagcttaattcagcattgggtgaggtaataaaccttaggaactagcatataattctatattgtatttctcacaacaatggctacctaaaaagatgacccattatgtcctagttaatcatcatttttcctttagtttaattttataaacaaaactgattataccagtataaaagctactttgctcctggtgagagcttaaaagaaatgggctgttttgcccaaagttttatttttttttaaacaatgattaaattgaatgtgtaatgtgcaaaagccctggaacgcaattaaatacactagtaaggagttcattttatgaagatatttgctttaataatgcctttttaaaaatactggcaccaaaagaaatagatccagatctacttggttgtcaagtggacaatcaaatgataaactttaagaccttgtataccatattgaaaggaagaggctgacaataaggtttgacagaggggaacagaagaaaataatatgatttattagcacaacgtggtactatttgccatttaaaactagaacaggtatataagctaatattgatacaatgatgattaactatgaattcttaagacttgcatttaaatgtgacattcttaaaaaaagaagagaaagaattttaagagtagcagtatatatgtctgtgctccctaaaagttgtacttcatttcttttccatacactgtgtgctatttgtgttaacatggaagaggattcattgtttttatttttatttttttaattttttcttttttattaagctagcatctgccccagttggtgttcaaatagcacttgactctgcctgtgatatctgtatcttttctctaatcagagatacagaggttgagtataaaataaacctgctcagataggacaattaagtgcactgtacaattttcccagtttacaggtctatacttaagggaaaagttgcaagaatgctgaaaaaaaattgaacacaatctcattgaggagcattttttaaaaact

SEQ ID NO: 1728 - DNA, 1809 bp, Homo sapiens
acgccggcgctcccaggccgcgcttcctgcgtccccaacccggtccctgagagggcactgcgccctctccaccactgcgttccctcggctaagaatcccccgaaccccagccccgcgatcgcggcgcccaccgaggaggccgcccgggtggggcgcgggggtcgcgaagcccgcagccccggaccgcccagccgagacggagccggacccgccgcctcccgggcccttccaccgcagctatccgcacgggaggcctcgcgattgctcggaaccatcccgcaggagttcagctgatattttctagtgtggggcgagagattttgtggagcgcatttaaggggtttttgttgtgactgctgccttgtatatatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcgggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaaattttgtgtttgctgtctacgctggagtcctgaactgtgggtagaaaacacgacctggctttgtagaaaggacacagggctgttttatgaactaagcggtgaggctcaggtggcggctctcacagagcccctgatgctgttgttctttgagggcttaaggcctgatgaacgtaggcacgtgatgcgtaatagtcttcaatggtacacttaactagtctcttctgtgtaacagc

SEQ ID NO: 1729 - DNA, 4079 bp, Homo sapiens
cttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagaggtcaaaaaaaaaa

SEQ ID NO: 1730 - DNA, 3052 bp, Homo sapiens
ggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggaggctgtcaaggatcatcctagagctgaatacgaagccagagtcttggagaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacaggatctccatggccgccgccttggccatgaactcctccccctccgtgcggtccaacatccgggtcacagtcacagccaccgcggtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccctagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggtttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctc

SEQ ID NO: 1731 - DNA, 771 bp, Homo sapiens
gtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctg

SEQ ID NO: 1732 - DNA, 1678 bp, Homo sapiens
agagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcaccctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattctcagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaag

SEQ ID NO: 1733 - DNA, 2008 bp, Homo sapiens
acaagaaaatgttactttaatatataatccatcagacagaggaatcaataataaaactgcaacagaactatcaactgtatacttatttggtggagatgaaatttcaagacagcagtatcgcagggccctgttacataaaccagagatgataaaacagatacttccagaacatagtgtgcttcaaaacattaattttgttgaagcatttcaagatgagctattagtaactgaagtatatgatcttccccaacgacctaatgatgttcagctcttttatggaagcatgtgtaaaattatactttcagtaattggagaattcagagattgcatttctagcagagaattccttcagccttcttccaaagctagcttggaatctacaagcgacttgggagcttctgggaaacatggtggcaacgtctctttggatgttttaccagtcaaaggtcctcagggttctcctcttctctcacgggcggctcgcccgcctccggatcagctggcctccgaagagccgtggactgtcctacccgagcacttgattctggtagctccttctccttgtgacatggcaaaaactggacgtttccagattgtgaataactctgtgaggttactgagatttgagctgtgctggccagcgcattgcctcacagtcacgccgcagcatggatgtgtcgcgccagagagtaaactacaaattcttgtgagtcctaattcctccttatccacaaaacagtcaatgttcccgtggagtggtttgatctatatacactgtgacgatggacagaagaaaattgtgaaagttcaaattcgagaagatttaactcaagtggaacttttaactcgtttgacctccaaaccatttggaattctttccccagtatctgagccttcagttagtcatttggtcaaaccaatgacaaaaccgccttccacaaaagttgaaataagaaacaagagtattacttttcctacaacagaacctggtgaaacttcagagagctgtctagaactcgagaatcatggcaccacagacgtgaaatggcatctgtcatctttagcgccaccttatgtcaagggagttgatgaaagtggagatgtttttagagctacctatgcagcattcagatgttctcctatttctggtctgctggaaagccatgggatccaaaaagtctccatcacatttttgcccagaggtaggggggattatgcccagttttgggatgttgaatgtcaccctcttaaggagcctcacatgaaacacacgttgagattccaactctctggacaaagcatcgaagcagaaaatgagcctgaaaacgcatgcctttccacggattccctcattaaaatagatcatttagttaagccccgaagacaagctgtgtcagaggcttctgctcgcatacctgagcagcttgatgtgactgctcgtggagtttatgccccagaggatgtgtacaggttcctgccgactagtgtgggggaatcacggacacttaaagtcaatctgcgaaataattcttttattacacactcactgaagtttttgagtcccagagagccattctatgtcaaacattccaagtactctttgagagcccagcattacatcaacatgcccgtgcagttcaaaccgaagtccgcaggcaaatttgaagctttgcttgtcattcaaacagatgaaggcaagagtattgctattcgactaattggtgaagctcttggaaaaaattaactagaatacatttttgtgtaaagtaaattacgtaagttgtattttgttaactttatctttctacactacaattatgcttttgtatatatattttgtatgatggatatctataattgtagattttgtttttacaagctaatactgaagactcgactgaaatattatgtatctagcccatagtattgtacttaacttttacaggtgagaagagagttctgtgtttgcattgattatgatattctgaataaatatggaatatatttt

SEQ ID NO: 1734 - DNA, 1344 bp, Homo sapiens
ccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggtgatgaagaaggaagagctcacctcccatcagtctcagctaaccgcctttttcctggaggccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgaaccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagaagccttgatgatgcctctggtggatcagctggaaaacaggcttgggggagaagagaaattccaggaacgggtgacaaagcacctgataccatgcatcgcacagttttcggtggccatggcggatgactctctttggaaaccactgaactaccagattctgctaaagacgagagactcctcgcctaaggttcgatttgctgctttgattactgtgttagcactggctgaaaaactaaaggagaattatattgtcttgctaccagaatccattcctttcttagcagagttgatggaagatgaatgtgaagaagtagaacatcagtgccaaaagactattcagcaactggaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttctttacaaaatccccacctggcttgtgctgccacataagcctctcctgcctatcgtatagagctgcagaaagagtaaatgatacacggtatttttatacag

SEQ ID NO: 1735 - DNA, 2809 bp, Homo sapiens
acttccggaatctctcggcgtgtgagcttggttgtcctaccaaagccagcgtttcggctcgcgtgcgccggcctagtttgctcgcgccctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatgaaaactcagagtgcccaaagaaggagccgaaggctaaaaaagccaaagtggcagataagaaagccagattaattattcggaacctgagctttaagtgttcagaagatgacttgaagacagtatttgctcaatttggagctgtcctggaagtaaatatccctaggaaaccagatgggaagatgcgcggttttggttttgttcagttcaaaaacctcctagaagcaggtaaagctctcaaaggcatgaacatgaaagagataaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggtatctaggaaaaaagctaagggaaataagacggaaacccgcttcaaccagctggtcgaacaatataagcggaaattattgggaccttctaaaggagcacctcttgcaaagaggagcaaatggtttgatagttgatgatggcagcaggctgggtaagaagctgggttgtgtactttctggtgacactcctgggctcctccccatcccccgtgtctctcactgagggaaagaaaatccccaagggcactgccactgtgctcggaggtgccctggactgtgtacatctgaactttggtccatcctttgatgtgtggttcgttagccacaaagagaaatatctgaaagtcaacatgatgcttcttgcatattatccagattattgtatgaagttgtgtctataattattaccaattttttattctttatttctcaaatggaaacacctgaaaaagcattctggagtgctgaatttttaagatgtatattttgttaagcatattctctaaatgagatattgtgtggctttttagtaacaacgtcatttctaat

SEQ ID NO: 1736 - DNA, 2094 bp, Homo sapiens
cctactaaaaaaaatgcagagaagtattccggcattttggaaggtcctgtggaccgacccgtactcagcaactattcggacacaccatcaggactagtgaacggtcggaaaaatgaaagtgaaccctggcagccttccttgaattcagaagctgtttatcccatgaactgtgttccggatgttatcactgccagcaaagctggagtcagttcagccctccctccagcagatgtctctgcgagtataggaagctctcctggggtagccagcaacctgacagaacctagttattcaagtagtacctgtggaagccacactgtacccagtcttcatgcagggctcccatctcaggaatatgccccaggatacaacggatcatatttgcattctacttatagtagccagccagcacctgcacttccttcacctcatccgtctcctttgcatagctctgggctactacagcccccaccaccacctcctccgccaccagccttggtcccaggctacaatgggacttctaacctctccagttacagctatccgtctgctagctatcctcctcagactgctgtggggtctgggtacagccctgggggggcaccgcctccgccttcagcgtacctgccttcaggaattcctgctcccacccccctaccccccaccactgttcctggctacacctaccagggccatggtttgacacctattgcaccgtcggctctgacaaacagttcagcaagttctctcaaaaggaaagctttctacatggcagggcaaggagatatggactccagttatggaaattacagctatggccaacagagatctacacagagtcctatgtacagaatgcccgacaacagcatttcaaacacaaatcgggggaatggctttgacagaagtgctgaaacatcatccttagcatttaagccaacgaagcagctaatgtcctctgaacagcaaaggaaattcagcagccagtccagtagggctctgacccctccttcctacagtactgctaaaaattcattgggatcaagatccagtgaatcctttgggaagtacacatcgccagtaatgagtgagcatggggacgagcacaggcagctcctctctcacccaatgcaaggccctggactccgtgcagctacctcatccaaccactctgtggacgagcaactgaagaatactgacacgcacctcatcgacctggtaaccaatgagattatcacccaaggacctccagtggactggaatgacattgctggtctcgacctggtgaaggctgtcattaaagaggaggttttatggccagtgttgaggtcagacgcgttcagtggactgacggccttacctcggagcatccttttatttggacctcgggggacaggcaaaacattattgggcagatgcatcgctagtcagctgggggccacatttttcaaaattgccggttctggactagtcgccaagtggttaggagaagcagagaaaattatccatgcctcttttcttgtggccaggtgtcgccagccctcggtgatttttgttagtgacattgacatgcttctctcctctcaagtgaatgaggaacatagtccagtcagtcggatgagaaccgaatttctgatgcaactggacactgtactaacttcggctgaggaccaaatcgtagtaatttgtgccaccagtaaaccagaagaaatagatgaatcccttcggaggtacttcatgaaacgacttttaatcccacttcctgacagcacagcgaggcaccagataatagtacaactgctctcacagcacaattactgtctcaatgacaaggagtttgcactgctcgtccagcgcacagaaggcttttctggactagatgtggctcatttgtgtcaggaagcagtggtgggccccctccatgccatgccagccacagacctttcagccattatgcccagccagttgaggcccgttacatatcaagactttgaaaatgctttctgcaagattcagcctagcatatctcaaaaggagcttgatatgtatgttgaatggaacaaaatgtttggttgcagtcagtgataacttctttag

SEQ ID NO: 1737 - DNA, 2450 bp, Homo sapiens
gagcttgtccagacgaagcctcgcagggatgggttggagcctgggccgtgcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttag

SEQ ID NO: 1738 - DNA, 1366 bp, Homo sapiens
tagtaataccagctgtaatcccagctacttgggaggctgaggcagaagaatcgcttgaacccgggaggcggaggttgagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacctcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtactcactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacgggacccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccc

SEQ ID NO: 1739 - DNA, 1978 bp, Homo sapiens
atcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagggtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaggaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaaccc

SEQ ID NO: 1740 - DNA, 1973 bp, Homo sapiens
gaaagactggagccgtttccttgtggctggagcgcttcccgtagcctcggggaaggagcaggatttagaggaccactagttggaccccatcctcgtgctggaggaacaggaacctctttcaggagctataaaagaaaggggggaatcatgtccacaattgcagctttctatggcggcaagtccatcctcatcacgggggccacaggctttctgggcaaagtgctaatggagaagctgtttcgcaccagcccagacctgaaagtcatttacatccttgtgaggcccaaggctggccagacactgcagcagagggttttccagatcctagacagtaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttacctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagggtattcaactttgacgtgcgccagttgaactggttggaatacattgaaaattatgttttgggagttaaaaaatacttattgaaagaggatatggctgggatcccaaaggcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgccttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcctttgcgtattaaacgtgaaagtactccc

SEQ ID NO: 1741 - DNA, 2307 bp, Homo sapiens
gtgactgtggagtttgaattgggtggcggttgactgtagagccgctctctctcactggcacagcgaggttttgctcagcccttgtctcgggaccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaagggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggcgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttttcttctgt

SEQ ID NO: 1742 - DNA, 2410 bp, Homo sapiens
attctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgtcactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatctgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactat

SEQ ID NO: 1743 - DNA, 3614 bp, Homo sapiens
agttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaacttt

SEQ ID NO: 1744 - DNA, 2084 bp, Homo sapiens
agcaatggcggttcccggcgtggggctcttgacccgtttgaacctgtgtgcccggagaagaactcgagtccagcggcctatcgtcaggcttttgagttgcccaggaactgtggccaaagaccttaggagagacgagcagccttcagggagcgtggagacaggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaagatctcaggaaattttctgatggaatttcaagtgaaaaatgttccttcagaaagaattgcaactcagaagatcctgtctgtgttaggagagtgccttgaccactttggccctggctgtgtgggtgtgcaaaaaatattaaatgcccggtgtccgctcgtgaggttctcacaccaggcctccggatttcagtgtgatttgactacgaacaataggattgccttgacaagttccgaactcctttatatatatggtgccctagactcaagagtgagagccttggtgttcagtgtacggtgctgggctcgagcacattcactaacaagtagtattcctggtgcatggattacaaatttctcccttacaatgatggtcatcttttttctccagagaagatcaccccctattcttccaacactagattccttaaaaaccctagcagatgcagaagataaatgtgtaatagaaggcaacaactgcacatttgttcgtgacttgagtagaattaaaccttcacagaacacagaaacattagaattactactgaaggaattttttgagtattttggcaattttgctttcgataaaaattccataaatattcgacagggaagggagcaaaacaaacctgattcttctcctctgtacattcagaatccatttgaaacttctctcaacataagcaaaaatgtaagtcaaagccagctgcaaaaatttgtagatttggcccgagaaagtgcctggattttacaacaggaagatacagatcgaccttccatatcaagtaatcggccctgggggctggtatccctattgctaccatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatagcaagattccatctct

SEQ ID NO: 1745 - DNA, 2149 bp, Homo sapiens
agcgccttcgctctttggctccctgagttagtccggttgtttgcgatcgccgcggccggggctgcgaaccgaagggctcgctccgcgccgcctgggtctctacctcatccgtaggtgtggccctgatggtgtggcaggctctggactcctaaagctctggagcgaatttaagattttattcatgtgcatggcatagaagatgaattcttccacttccaccatgagtgaagagcctgacgctctatcggtagttaaccagttacgggatctagcagcagatccgttaaacagaagagccatcgtccaggatcagggatgtctgcctggccttattttatttatggaccatcccaaccctccagtcgtccactccgctttgcttgctcttcgatacttggcagaatgccgtgcaaacagagaaaagatgaaaggagaactgggtatgatgttgagcttacaaaatgttatacagaaaactacaactccaggagaaacaaaacttctggcctctgaaatctatgacattcttcagtcctccaatatggcagatggtgatagttttaatgagatgaattcacgtcgaaggaaagctcaattttttctgggaactacaaacaaacgtgccaaaacagtggttttgcatatagatggccttgatgatacgtctcggagaaatctatgtgaagaggctttgttaaaaattaaaggtgttattagctttacttttcaaatggctgttcaaaggtgtgtggtgcgaatccgttcagatttgaaagctgaggctttggcatcagcaatagcatcaaccaaggttatgaaagctcagcaagttgtgaaaagtgaaagtggagaagagatgttggtcccattccaagatactcctgtggaagttgaacagaacacagagctacctgactacctgcctgaggatgagagtcccacaaaggaacaggacaaagcggtgtcccgggtcggctcacacccagaaggtggagctagctggcttagcacagctgcaaactttttatccagatcattttattggtgacttcacttttgggctcaaggactgtgtgaaccaacaaggggccagttttccattgttgtggtgaactgtcaagtgcaatttgcaataagttatcatgaaaagtttttagattacacgatcgcatatgctgcatttcacattttattggacattttaccccactgagtggtaaaaaggacagaggctacagatggagttgctttgtttatgaaagtattttggtttgttttctttcatttaattgcctcatatttaaaaaccatgggtccactgttaaaaccacatgtgtatgtgcagctttacattttattttacgtgaagcatgtgattaggaaaactcattttcttttcaagcctcaggacctacctgaagagaagttttcttgtagctcaagttgtgcatgaattactgaatattttactgtgcttttcttcatgaagggtacatgctttgtactcttcactgaaagctgaaaacatttcttgttaccctcttttgtgcctttttattttgccaaccgtgtttatagaaaggacattactaatgacattttgcagattaaaaacattcatttgaacacagtagtcccctagaaaaacaactctacaaaaattttgcagccttattcattataattttgataaaattaacacaaaatcagtcaagaaggaaacatgtatattagtgaagtgtttttggagactgtttgaatgtgaccaaatgtggttctagttgacttcttttcactttggcttatatcaattcttgagagttaatgtgatcatgatattgcaaacaactataaatggtctctaggccttactttgtgattatacgttatctccggctagaaaaaaataatggtagtaaagaaactgacaaactgaaaataagaaaacaaaaatcaaatgcctataataccataatgccagtttggtatagagtccaactttaaaacatgaattgctcgacagagttctattcagtaggtgtttccttgtattgtcttttgtgaatttattatgaaaatgctgcgttgtgttgaatgaaaaagacccaaattactgcttatgaagaaataaagccagcattgatcactt

SEQ ID NO: 1746 - DNA, 3887 bp, Homo sapiens
gcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgcacagaaaaaaaaatatattacatttcagacttggaaacatgcttcaattctaattcagcaacattatcgaacatatagagctgcaaaattgcaaagagaaaattatatcagacaatggcattctgctgtggttattcaggctgcatataaaggaatgaaagcaagacaacttttaagggaaaaacacaaagcttctattgtaatacaaggcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccacattagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgt

SEQ ID NO: 1747 - DNA, 2232 bp, Homo sapiens
gaaattgcacacttaaagacatcagtggatgaaatcacaagtgggaaaggaaagctgactgataaagagagacagagacttttggagaaaattcgagtccttgaggctgagaaggagaagaatgcttatcaactcacagagaaggacaaagaaatacagcgactgagagaccaactgaaggccagatatagtactaccgcattgcttgaacagctggaagagacaacgagagaaggagaaaggagggagcaggtgttgaaagccttatctgaagagaaagacgtattgaaacaacagttgtctgctgcaacctcacgaattgctgaacttgaaagcaaaaccaatacactccgtttatcacagactgtggctccaaactgcttcaactcatcaataaataatattcatgaaatggaaatacagctgaaagatgctctggagaaaaatcagcagtggctcgtgtatgatcagcagcgggaagtctatgtaaaaggacttttagcaaagatctttgagttggaaaagaaaacggaaacagctgctcattcactcccacagcagacaaaaaagcctgaatcagaaggttatcttcaagaagagaagcagaaatgttacaacgatctcttggcaagtgcaaaaaaagatcttgaggttgaacgacaaaccataactcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtccagtctctttacacatctctgctaaagcagcaagaagaacaaacaagggtagctctgttggaacaacagatgcaggcatgtactttagactttgaaaatgaaaaactcgaccgtcaacatgtgcagcatcaattgcatgtaattcttaaggagctccgaaaagcaagaaaaaataacacagttggaatccttgaaacagcttcatgagtttgccatcacagagccattagtcactttccaaggagagactgaaaacagagaaaaagttgccgcctcaccaaaaagtcccactgctgcactcaatggaagcctggtggaatgtcccaagtgcaatatacagtatccagccactgagcatcgcgatctgcttgtccatgtggaatactgttcaaagtagcaaaataagtatttgttttgatattaaaagattcaatactgtattttctgttagcttgtgggcattttgaattatatatttcacattttgcataaaactgcctatctacctttgacactccagcatgctagtgaatcatgtatcttttaggctgctgtgcatttctcttggcagtgatacctccctgacatggttcatcatcaggctgcaatgacagaatgtggtgagcagcgtctactgagatactaacattttgcactgtcaaaatacttggtgaggaaaagatagctcaggttattgctaatgggttaatgcaccagcaagcaaaatattttatgtttcgggggttttgaaaaatcaaagataattaaccaaggatcttaactgtgttcgcattttttatccaagcacttagaaaacctacaatcctaattttgatgtccattgttaagaggtggtgatagatactatttttttttcatattgtatagcggttattagaaaagttggggattttcttgatctttattgctgcttaccattgaaacttaacccagctgtgttccccaactctgttctgcgcacgaaacagtatctgtttgaggcataatcttaagtggccacacacaatgttttctcttatgttatctggcagtaactgtaacttgaattacattagcacattctgcttagctaaaattgttaaaataaactttaataaacccatgtagccctctcatttgattgacagtattttagttatttttggcattcttaaagctgggcaatgtaatgatcagatctttgtttgtctgaacaggtatttttatacatgctttttgtaaaccaaaaacttttaaatttcttcaggttttctaacatgcttaccactgggctactgtaaatgagaaaagaataaaattatttaatgtttt

SEQ ID NO: 1748 - DNA, 2414 bp, Homo sapiens
gaaatctgtacgaactattcaggctgcttttagaggcatgaaagttagacaaaaattgaaaaatgtatcagaggaaaagatggcagccattgttaaccaatctgcactctgctgttacagaagcaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctgtattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctctcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctctgtgtacaacttttaaaatctgactttgttttaaaaaaacataaactgttcattacattcttcatttttatcatttatagttttatgcatgtaataaactaatatgtcataagatg

SEQ ID NO: 1749 - DNA, 2415 bp, Homo sapiens
aaaagacgccgggcgcggcggcgcgcggagaagtgcggcggagcggcgcctgcattagcaggtatgcaaagaagccttttcaccctgatgtccttagagataatatggatcagtccagagttctcctctgggtgaaagcagaaccctttatagtgggtgccttgcaggtcccccctccatccaagtttagtcttcactatctcaggaagatatccacctatgtgcaaatccgggccacagaaggagcttacccgcgcctctactggtctacatggaggcacatcgcttgtgggaagctgcagttggccaaggacctggcgtggctttacttcgaaatatttgatagtctttcaatgaagacacctgaggagcgcctggaatggtctgaggttctgtccaactgcatgtctgaggaggaagttgaaaagcagagaaatcagctttcagtggacacgctacagtttctgctcttcttatacattcaacagttgaacaaggtctccctaaggacatctttgattggcgaagagtggcccagtcccagaaacaaatctcagtctcctgacctgactgaaaaatctaattgtcataataagaactggaatgattacagtcaccaagcttttgtctatgatcatctgtctgatctcctcgagctgcttttagatccaaaacaactcactgcatcatttcattcaacccatagtagtctagtgtctcgagaagctgttgtggcgctcagcttccttattgaaggtacaataagtagagccaggaagatctatccacttcatgaacttgcactgtggcaaccactgcatgcagatagtggcttctcaaagatctctaagactttctctttctacaaactggaaacctggttgaggtcctgtttgactgggaatccatttggtacatcagcttgcctcaagtctggaaagaaattggcttgggctcatcaagttgaagggaccaccaaaagagctaagattgcttgtaatactcatgtggcccctaggatgcaccgactggtagtgatgagccaggtttacaagcagacactggctaagagctcagacactctggcgggggcacatgtaaagattcatcgttgcaacgaatcttttatatatctgctctctcccttacgatctgtgacaattgagaagtgcaggaatagcatctttgtcttgggccctgtagggactacacttcacctccacagttgtgacaatgttaaagtcattgctgtttgccatcgtttgtccatctcttctacaacaggttgcatctttcacgttcttacgcctacacgcccacttattctctctgggaaccagacagtaacttttgccccttttcatacacattacccaatgctagaggaccatatggccaggactggccttgctacagtgcctaactattgggataatccaatggttgtgtgcagagagaacagcgacacaagagtcttccagcttttaccaccttgtgaattctatgtatttattattccctttgaaatggaaggggacacaacagagatacccgggggtcttccatctgtatatcagaaagcactgggtcaaagagaacagaagatacagatctggcagaaaactgtgaaggaggctcatttgacaaaggatcaaaggaagcagttccaggtactggtagagaacaagttttatgaatggttgattaatacaggacatcgccaacagctggacagccttgtaccccctgcagcaggctccaaacaagcagctggataaggatcttacatgcagacactgggccctggaaatacaaggataaatggaggatggtgctcatcttgaaacttgaaactaaattgggaaggtgctattgctgcttaagagacattgggacttttctgtcttttttttttttttttttttgaggcagagtcttgttctgtcgcccaggctggcgtgcagtggcgcgatctcggctcactgcaagctctgcctcccgggttcacgccattctcctgcctcagcctcctgagtagctgggactacaggcgcccgccaccacgcccggccaattttttttgtatttttagtagagacggggtttcaccgtgttagtcaggatggtctcgatctcctgacctcgtgatccgcccatctcggcctcccaaagtgctgggattacaggcgtgagccaccgtgcccagccttctgttctatttaagaactttgatttccattccattttcatttattactgtttaggccgaattttcgctaaacttctgactttcatataaacatattgcttatagaacatcagaagactcatctttgtgatgcccaaatgaaaaagttggtgaaggtagtaccattgtatgtatgttaatattaaagcaactgagtgtagatttgc

SEQ ID NO: 1750 - DNA, 1054 bp, Homo sapiens
attcaagcctgggccctggaaggaggggtggacagtcccctcccttccagtccagcatgggtctggggaagaggagcagctttgcctggaaggggcctcctaggagggggagcggtggtttctagctcaggctttaggatcagagagcagcagattcaaatcctgacggttttggtaaagtcaattcaatctctccaagactccgtttacttgatctgcgaagtggggataatggtatcacgtcgcagggttgtcaggcggagctggtaggggagctgccccccagagcagcatggatgccccgcgaagggacatggagttgctcagcaacagcctggctgcctacgcgcacatccgcgccaaccccgagagctttggcctctacttcgtgctgggcgtctgcttcggcctgctgctcaccctctgcctgctcgtcatcagcatctcgtgggcgccccgcccgcggccccggggcccggctcagcgccgggacccccgcagcagcaccctggagcccgaggacgacgacgaggacgaggaggacacggtgactcggctgggccccgacgacacgctgccgggccccgagctgtccgcagagccggacgggcccctcaacgtcaacgtcttcacgtcggcggaggagctggagcgggcgcagcggctggaggagcgcgaacggatcctgcgggagatctggcgcaccgggcagccggacctgctgggcacaggcacgctggggcccagccccacggccacgggcaccctgggccgcatgcactattactgatgggccctggctcccgccgcaaggcgctcggggtaccggacctgtacatgagctcagagctaccccacaccttcggactgcctcggcccccacagctcccaggtgctactgggcgtggaccgccaccccctgagaggctcccttccccagtcctgccagaagaccccgggggcggggagggggcagcatgcagggtccccactccctctctggggtcgatgaagaggtgaagtgaccaaatgaaagaaagctgcattctcagtg

SEQ ID NO: 1751 - DNA, 2631 bp, Homo sapiens
accttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaaccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccgccacctgggagaggctttatttcttcacccaaggcgggaatctcatgtgtcagcccaggggagccgtggctggaggtttgatccaggacctggacaactgctcagtgatggccgtggattgcgaagaccggcgctactgctttcagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcctattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggagcgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagccaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgatggaaaatatgtactgttaaacgatcaaccagatgacgatgatggaaatccaaatgaacatagaggcgcagaatccgaagcataactcacttgcgcctgtgggggaagagcgaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcataattggacctaatagcatttctttgtgcagttaggtgatgagcactgctttgaggcccaagcactagtagagatgcgcgatacaggtctagtttcggtaactgttccagacatcaagc

SEQ ID NO: 1752 - DNA, 2792 bp, Homo sapiens
attgcttctgggactaaaagataaagaggggtacacatctttctggaatgactgcatatcatcaggcctgcgagggggcatcctgatagagctggccatgcggggtcgaatctatctggaacccccgaccatgcgtaagaagcgactactagacagaaaggtactgctaaagtcagacagcccaacaggtgatgttttactggatgaaactctgaaacacatcaaagcaactgaacccacagaaactgtccaaacatggatagagctactcactggtgagacctggaaccccttcaaattacagtaccagctgagaaatgtacgagagcgcatcgcaaagaacctagtagagaaaggtattctaaccactgagaagcagaatttcctgctatttgacatgactactcatccagtgaccaatacaacagagaaacagcgactagtgaaaaaacttcaagatagtgtactagagcggtgggtaaatgaccctcagcgtatggacaagcgaacactagcactcctggtgctagcccactcctctgatgtgctagagaatgtcttctcctctctgacagatgacaagtatgatgtggcaatgaatcgagccaaggacttagtagaactggaccctgaagtggaagggacaaagcctagtgccacagaaatgatctgggctgtgctggcagccttcaataaatcttaaagccggcaggtggatttctccttttcccctgctggctggtgactgtcagagaccccatcactgagttttgtgcgatgagatgttttcatcatttttgtttccttttcttgaatcagacttgtgatttggggagagcaacttcagggcttctccatagaccttgaccattataagcagaccttatttctccctacacttccactccataggtaaataaactgggtgaacccacacacacccaatgaacattttctcccatttggtggtttagtttcacccagtgtgcttttggataagcagaaatatctaaatgggattttgagttctccagctatagaatgtgaatgagataaaaagtgaactatctattatatttttctgagtttgttttctatcataaatacatgttttcacagcctttgtctctcagactctgctaaataatgtagcttattgaaataactgtcgctgaataaggagcaatgagaaacaaaactaatttttggagcagatggtctctggaattgcatatcctgctagtgattttctcatctttccttttctaacctaatgagaatgtcccagattcaattacctggatgtcaaagtcctagagccagaaatatattctctcatccctcttagcattctcttgctccctcattcactagggcaaatgtctaaatgaagaaaagtctctctcaacacctcgttcatgcaatcagcattagaatttgtaaggaaggaaggggggtggcatgaaaatttccattcttggggtatatgactgtcctgtttcccccaggccactttttttttttttcttttgagacagggtcttgctcttgcccaggcaggagtacagtagtgcaatcacagctgactgcagccttgacctccagggctcaaggatcctcctgcctcagtctcccaactaagtgggactacaggcacgtgccaccatactcagcttttttttgtttgttttagacaagagtctcgctttgttgcccaggctggtcttgaattcctgggctcaagcaactcttccacctcagcctcccaaagtgctgagattactggcttgagccactgcacccacccctccagactactttaaatgtctctgctctgactgagttgaaggaattgtaagtttcagttgctgaatatatcagtatatctgaactccggatctttttatttcctatttttggcttcctacataaattaataaagtctgtctatatttaaggtttctgggagtagttttgtctatatttaatccatagatgtgctcctagtcatcagtcttatttcagtaaaaccatctttctggccaaatctctaacacgttttttacttcagtagtgagggcaatgagaagctttattaagaaagatcctatttaaagggctaatttggtattgaaagcatgctgatataaagtccagtatttgaggatataaagaggatgtgcactgagctgtgctgatgttcagcatttattatactttaatgggatagtgcttcttgaccattatagaacaacaaactgtcaaagggttaatacagatgacccagacctgacattaaatcctcttgattagaaataattaaatgaattatttattcatttctctcctctgccaaatctacttagccccacaaaaatgccccagctcagttaacatttttttgtttttcactttaggtatctcttaggcaaatagagatataaattgtaataggaaacagtctctaaatgtgaggctgaatacagcttcagtctggctctctaataggacaaaagccagtccatgtgttgtctctcactgatttagctttttcttttctttgaacaattcggcatgaattgaaaccaggttttcctgtggaaagttatagcttgattgggagatagaagttgaattgagttctttcttgcaactcttagtgtttatttttatatctcagtaagacgaggataccttcagtttgaatctgcataatgttcactgccaaactccttctcatttaatgcttatggccttcacatttctgtataataaagatcaattatcagctc

SEQ ID NO: 1753 - DNA, 3354 bp, Homo sapiens
taattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaaaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcgatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaaaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaagcaaatgaagaaacacccctgccgccagtgtgacaagtctttcagctcgtcccacagcctgtgccggcacaaccggatcaagcacaaaggcatcaggaaagtgtacgcctgctcgcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttggcccttgt

SEQ ID NO: 1754 - DNA, 2732 bp, Homo sapiens
gaagctctcctgtttgacgaaagtatgtctcaggaaggtgcggtcccagctagcgcggttcccctggaagaattaagtagctggccagaggagctatgccgccgggaactgccgtccgtcctgccccgactcctctcattgtctcaacattctgaaagttggattgagcatattcactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagaccttgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagtt

SEQ ID NO: 1755 - DNA, 3334 bp, Homo sapiens
atgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagcccctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacaccggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaattt

SEQ ID NO: 1756 - DNA, 2485 bp, Homo sapiens
aaaaaaaaaaaaaaaaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcggcttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaaccaaccagagcagttcgactgggccatcaatgaccgcatcaatgagatggtccacttcgacctgccagggcaggaggaacgggagcgcctggtgagaatgtattttgacaagtatgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcctccgaggacggggtcctgaccgaggccatgatggacacccgcgtgcaagatgctgtccagcagcaccagcagaagatgtgctggctgaaggcggaagggcctgggcgtggggacgagccttccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccagcccctgcccaggccactgtgagggtgggtgctggctgaccccccggggcagcaggagccaggcaggtgatgtctttgttctcggctcccacagcagagccaggtgagggggcgcctgccagggccagacccaggtggggcagcctgaaccctgcttccccctgtggccggcatgccccgatctttcacacactggtgaccctgagagaggagggaggagggaacctggcgggggtgtctgaggccgcactgtcagctggccggtccaagcctgtggctggagctggggtctgtttacctaataaagtcccacaggtgcctcatt

SEQ ID NO: 1757 - DNA, 3598 bp, Homo sapiens
aaaagggcagctccgggggaaagagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaaactctcagcgtaggcatcgggaaccttcgtgccaaggagccatgccgccccgatgggaactggcactttacctacttgcctcactaggcttccacttctattccttctatgaagtttacaaagtctccagagaacacgaagaggagctggaccaggaatttgagctggagactgacactttatttggaggattaaagaaggatgcgaccgactttgagtggagcttctggatggaatgggggaagcagtggctggtgtggcttctccttggccacatggtagtgtctcaaatggccacactgctggcaagaaagcacagaccctggattctcatgctctatgggatgtgggcctgctggtgtgtgctggggacccctggtgtggctatggttttgctccataccaccatctctttctgcgtggcccagttccggtctcagctcctgacgtggctctgttctctcctcctcctctccacactgaggctgcagggtgtggaagaagttaagagaaggtggtacaagacagaaaacgagtactacctgctgcagttcacgctgaccgttcgctgcctctactacaccagcttcagcctggagctctgctggcagcagctgcctgctgcatcgacctcctactcctttccctggatgctggcctatgtcttttattatccagtcttacacaatgggcccatcctcagcttctcggagttcatcaaacagatgcagcagcaggagcatgactccctgaaggccagcctgtgtgtcctggccctggggctgggccgccttctttgctggtggtggctggccgagctgatggctcacctgatgtacatgcatgccatctacagcagcatccccctcctggagactgtctcttgttggaccttaggaggactggcgttagcccaggtgctctttttctacgtgaagtacttggtgctctttggcgtgcctgctctgctcatgcgcctggatggactcactccacccgccctcccccgctgcgtgagcaccatgttcagtttcaccgggatgtggaggtattttgatgttggactgcataatttcttaatcaggtatgtgtacattccagtgggcgggtcccagcatggcctgctggggacactgttttccacggcgatgacatttgcatttgtgagctactggcatggcggctacgactacctctggtgctgggcagcgctcaactggctgggagtcactgtggagaatggagtccggaggctggtggagactccctgcatccaggacagtctggcccgatacttctccccacaagctcgccgtcgattccacgctgcccttgcttcttgttccacctcgatgctgatcctgtccaacctggtatttcttgggggcgatgaggttgggaaaacctactggaataggatcttcatacaaggctggccttgggtgaccctctctgtcctgggattcctgtactgctactcccacgtgggcattgcctgggcccagacctacgccacggactaatgctgttgggcccaggccagtcattgttgctggcctccaaggcaaatagtgcttcaccctgacctctcactccaggacagcctctaagggatttgatctgctcatcttcagttgaatgccctcactccaagactggatgctggatctcatagaaaattcacagccagacaatcttctaatctggagtctttgagatcttctaccccaactcatcattttcctattgaggaaacgggtccagggcagtcgtgtgtcttacccagctacacagggtgacattttggtctagaacctagtctcatgagccctttgcattctttccccttaagcaagaatagaatgtagtggaaatttattgattgagacacagaaatcctgattagtgataggcctgtcttctgggcaatatttctaaaatatttgagtgacattgatgtttaagtgacctccttcatcacatcctgcagtatctccagaagcagcactagggtttgagtttcatgcttcagcccctctgtaggaatgagaccaagccacagctgtcttttgaattacgtagtcgaagaagacggtagcagccctgtagcattctaaggcatctatacccaaggagtcctgtgatttgagcttcagcagggtgatctacatttgggtgcttgtttctgagatttgcagagaagtataacatggtagttcctctaccttacagttaatcgtttcttaataaagaagcagaatttagaaaccacaggatagtgtacccacagatgggtgttatcaaggccagtcatgaggatggtgtcctggagtcttgtccaccctctccatacaagtctcaaaagtcatcctcctactcagtgattcacgtttagtggtttatattattaaggtttgattcaaacagagccttttctgtcctgtagataatctacatgtttgtagaattattttgaatatgtttgaggaaaatgtttaaaatctaaatatactcacataacttgattattcactcctctgaaaagatgctggataggctaccaaagttcccaagtggtagataattcagaagacttgtttgaatttggatttttttttttttttttggagtggggaagggtataaaggaggcttaaaatttgaatccataatatatctaattacaggagaatttacaacatctcaagtacgtaaattaagttgtcattgagtgaaaggttcacttggacctagtgctgcctcctgtttattacatagcatggcccttatgtcttgagttgaggttatcatctcaatgaggcttaagctcctagagtacaggaccattttgttgattgtctttcttcatagcttctctgcttggcaaagagatgggagggggccagatactgactacctggggtaggcacattgtgtgttaaagcaagacagaggccagagaggggcaggtagacctgcatagcagcagcctcagcagctgtcttggtaaaggagagagagagacatggggccagtaattccggggtgctcagaagttttaggagggaatgagcctcagggaggagtgagcacctaaatgaacgcagtaaaccttcatggaccaacagtgattgaggatttgtgggcagccagagggagtctgactgaagtttacttggaaagaaagggcttgctaagaaaaaagggagtaaaaatgatgatagggaagtgtctaatgtatgtgcacatataagtaatacaaaagttttgagctcttccaagtataccatttatatacaaacaaataggtttattcattcattaaactactttggaagcgtcagtggatatatttgaaagtggtaatcctgaatctcttttaaactattatatgattcataatggttctcaggaattaataaatgattactgtgtttagctctg

SEQ ID NO: 1758 - DNA, 2330 bp, Homo sapiens
aataagactctatcaagatccatagcatctgaagttgtagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcagcctattgaagagatgcgacacacgattgtagatattctaacaatgaagagtcaagaaaaagctaatttaggagaaaatatggagaagtcttgtgcaagcaaggaagaagtccaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaagagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggtttttattatttgtggggtgttttgttttgagtagctttatattgctcttaggtctggagttggccatgtacctatgtatcctaagcattcacggcagtgagctcctttactaacattcatgttatggcaagagttgtcctctacattggaaagctaatcctaccttgtcagtttcaaccaactgagttttttctttaagaaaggtaaattttgtcagctagtttactatgttccttgaatataaacaggttataatactaccctgttcactttactaaatataagtacagtaatgatgcataattagaaaatgaggtattctaggtaaaatgtatgtttgccttgacatgtttttaaaagttatgatgtacctccctgcctttaaacagaatacttttttcttttttttggcctttctcagattagtcaaaaattctatagaatgactcacttcgaatactaagacacaggaggtttagcctgctttcttaccaaattcatgttacccagacttgtgttctcttgcgtcccttggactgcctgttgattgatggaaagtgtctgcactgacacttttcgtcagtagtctgtagtttcgtggcctcttttgattataactggggtcaccaagaaggtttacttaattaaataccgcatttctaagagaagatactttgtgtaagaaaagatgccacatttagtggtttaacttttgtaacttcacttgatagtttttaagcaattagaatggagttagggaaagaacatatcatactgaacaaatgtcattctagtttagatagcatttctaagataactgatactaatacttgttttcttccctataacataaaaaacttcactgttaagtcatgtcccttgaaacatgatagttacatacacagttttctctccacacataaataacaccactaaagttgttttgtaaggttccaaactaatatggcatatatcaactctacagtttcaaataaatgactttttaattgtaaaagattagttgaaaaactgtatgaatgtgaagatcacatgcttagtcatttttatgttcattccactttgtatatcttttctatttattgacttctcatgttctagagagtaggacttttattccgtgtacctgatatatatacaattaaaatatctgtataatt

SEQ ID NO: 1759 - DNA, 2430 bp, Homo sapiens
gctagcgtctgccgcggctccgagggggtggggctgctgggaatggctgtgcccccttcggcccctcagcagcgcgcgtcctttcacctgaggaggcacacgccttgcccgcagtgctcatggggcatggaggagaaggcggcggccagcgccagctgccgggagccgccgggccccccgagggccgccgccgtcgcgtacttcggcatttccgtggacccggacgacatccttcccggggccctgcgcctcatccaggagctgcggccgcattggaaacccgagcaagttcggaccaagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcaggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctgggtcctagctgtgtgtcttccacaatgactgcatccctccagtgctgtagagtcggaaacaggcatggggagattgccaggctgaccctctctggtctgtttccaggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccgg

SEQ ID NO: 1760 - DNA, 2943 bp, Homo sapiens
ccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttctgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgggctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgac

SEQ ID NO: 1761 - DNA, 3106 bp, Homo sapiens
cagcgccagctccgcgtcccgaccggcccgcggcagcctgcgccgcgccatggccacctccccgcagaagtcgccttctgtccccaagtctcccactcccaagtcgcccccgtcccgcaagaaagatgattccttcttggggaaactcggagggaccctggcccggaggaagaaagccaaggaggtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttgcatgttctaaagttgtgtatgtgtgtgcacatctgagcacgtgcacatgtacacctgagccaaaaacacgagaacccactgatctcaccactggggcaagctaggtcagagcttagtgattcacactgaaattggcaaattggatttaacccaattaatagtgtgtgtgtggcaggagtcatgtccctcacatcctttgtacaaatgaaaattactcttaattccttcagatttataataactctgtactttggtttcagggtgacatttgggaaggattttgtttagaattaatggagtggcacattttgcagcctttttgcttgattgcatgtaatggaaatgccctatattttcctgcaaaataagtactaaattcattatcgttaagcaaatgtacaatatgctcaggcaccgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacat

SEQ ID NO: 1762 - DNA, 3369 bp, Homo sapiens
agatatgaaactggttctggagtgagatgagctcggctggggacgctacttgagaaggcctttccccacagggtgacttaaatgtcccaggctggaaggtggagcgagaagtggatgcccccagggctctgggtcacactccaggatgacttctcggaaccagctggtgcagaaggtgctgcaggagctgcaggaagcagtggagtgcgaaggcctggagggtctcataggtgcttccttggaggccaagcaggtcctgtcttccttcactctccccacctgccgggagggaggccctggcctccaggtgctggaagtggactcggtggccctgagcctgtatccagaagatgctccacggaacatgctgccgctggtgtgcaagggggagggcagcctgctgttcgaggcggccagcatgctgctgtggggtgacgcaggcctcagcctggagctgcgggcccgcaccgtggtagagatgctgctgcacagacactactacctccagggcatgatcgactccaaagtgatgctgcaggccgtgcgctactccctatgctctgaggagtcccctgagatgaccagcttgccccccgccacgctggaggccatcttcgatgccgacgtcaaggcctcctgtttccccagcagcttctccaacgtgtggcacttgtatgctctcgcctctgtcctccagcggaacatctactccatctaccccatgcgcaacctcaagatccggccctacttcaaccgtgtcatccggccccgccgctgcgaccacgtgccctccacgctgcacatcatgtgggctggccagcccctcaccagccacttcttccgccaccagtactttgcccctgtggtggggctggaagaggtggaggctgaaggtgcccctggcgtggccccagctcttccagccctggccccactctcatcgccggccaagaccctggagctgctcaaccgtgaacctggcctcagctactctcacctctgtgagcgctacagcgtcaccaaaagcaccttctaccgctggcggcggcagtcccaggagcaccggcagaaggttgctgcccgcttctccgccaagcacttcctgcaggacagcttccaccgggggggcgtcgtgccacttcagcagttcctccagcggttcccggagatctcccgctcaacctactatgtctggaagcatgagctgctgggctctggcacctgcccggccttgccccccagggaggtgctgggcatggaggagctagagaagctgccggaggagcaggtggctgaggaggagctggagtgctccgcactggcggtgtcaagccctggaatggtcttaatgcagcgggccaagttgtacctggagcattgcatctccctgaacacactggtaccctatcgctgcttcaaacgcaggttccctggcatctcacggtccacttattataattggcggcgaaaggccctccggaggaaccccagcttcaagccggcaccagccctctctgctgctgggactccccagctagcatctgttggggaaggggctgtaattccttggaagagtgaggcggaagagggggcagggaatgccacaggtgaggaccctcccgcccccggggagctcctgccactaaggatgcccctgtcccgttggcagaggcgtctgcgcagggctgcccgcaggcaggtgctgagtgggcatctccctttctgccgcttccgcctccgctaccccagcctgtcaccttctgccttttgggtctggaagagtcttgctcggggttggcccagaggcctgtccaaacttcaggtgccggtccccaccttgggcaaaggggggcaggaggctgaggagaagcaggagaaggaggctggcagggatgtgacagctgtgatggccccacctgtgggggcttcttcagaagatgtagagggagggccttccagagagggggccctgcaggagggggccacagcccagggccagccccacagtgggcccttgctgagccaacctgtggtggcagcagcgggtggcagggatggccggatgctggtgatggacatgatcgctaccacgaagttcaaggcccaggccaagctgttcttgcagaagcgcttccagtccaagagctttccctcctacaaggagttcagtgccctctttcccctcactgcccgctccacatactacatgtggaagcgagccctctatgacggcctgaccctggtagatggctgacagggaggtacaaaaggggctgggaagaagggggaccagtttggagagggtcagggacctgagctgaccccaggcttggccaggatgtcctttgctctgggtcccacagtgtctaccctaagtccaagggtatatttgtgttattttctggctccaggacagagaatgccagaaatcagccatctggtctcccgtaggaaactgtgggaccagagatatcctctttcgttgtttgctggtcatatttttactgttatgatttagtttttggttttgatttgagtgggttggttggcccccttgctggagttggaagccgtatgtatgtcagggggtttagaggggggttggttagctagagctgctttcagcttttcctggagacaaaaggagtgttatagcatgatcatcggtcccactgggcagaacgttatcttcagtttcttttgggggttggcatcctctttactcagttgtttcccaaaggaacattaggctcgaatatgggggccaggtgtggtggcttatgcctgtaatcctagcgctttgggaggccaaggcaggaggatcacttgaggctaggagttagagaccaccctgggcaatgtagtgagacctcatctcttagaaaaaaaaaaagaaagaaaatcaaatgtagagctgatcagcagcttgtgcctggcatccccaagggagaaggtgccaggtcagcaggagcagcagcagggatgtatagaaagaaccacagctggcctctaaaggatggcactgaggcaccggagatcttgaggcactggagatcactgaggggctggcctgtcccctgcaaggagtgtgggaccaggtggggcaaggctgggagatgcaggctctgtttgcagattatggcccagagtctctgcttgtgggtgcttgatccacctgctgggaccctgcagtcctcggccagcctggctgtcagttggggattccacctttctgctgagcgccttctcggagctggaggcccatcttcagtgagagatcacaaagcggccaggcaggtgggagactgaatttgccttgttcgagagtaacgtttgaaaaccaaagaaataaagtgatgcagtgcccac

SEQ ID NO: 1763 - DNA, 3912 bp, Homo sapiens
accgccttcgccgcggaccttcagctgccgcggtcgctccgagcggcgggccgcagaggttcaagcgattctcctgcttcagcctccggagtagctgggattacaggcacgtgccaacacacccagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtatccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccatccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctgggggggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaacgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccctccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacggtataaaagcagtgcaaataaacacctaaccttctgc

SEQ ID NO: 1764 - DNA, 2494 bp, Homo sapiens
agttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacagtggatttgtaaacaggatggctccccttctactgaattagtttctggaggatctgataatcaagtgattcactgggaaatagaggataatcagcttttaaaagcagtgcatcttcaaggccatgaaggacctgtttatgcggtgcatgctgtttaccagaggaggacatcagatcctgcattatgtacactgatcgtttctgcagctgcagattctgctgttcgactctggtctaaaaagggtccagaagtaatgtgccttcagactttaaactttggaaatggatttgctttggctctctgcttatcttttttgccaaatactgatgtaccaatattagcatgtggcaatgatgattgcagaattcacatatttgctcaacaaaatgatcagtttcagaaagtgctttctctctgtggacatgaggattggattagaggagtggaatgggcagcctttggtagagatcttttcctagcaagctgttcacaagattgcctgataagaatatggaagctgtatataaagtcaacatctttagaaactcaggatgacgataacataagactgaaagaaaatacttttaccatagaaaatgaaagtgttaaaatagcatttgctgttactctggagacagtgctagccggtcatgaaaactgggtaaatgcagttcactggcaacctgtgttttacaaagatggtgtcctacagcagccagtgagattattatctgcttccatggataaaaccatgattctctgggctccagatgaagagtcaggagtttggctagaacaggttcgagtaggtgaagtaggtgggaatactttgggattttatgattgccagttcaatgaagatggctccatgatcattgctcatgctttccacggagcgttgcacctttggaaacagaatacagttaacccaagagagtggactccagagattgtcatttcaggacactttgatggtgtccaagacctagtctgggatccagaaggagaatttattatcactgttggtactgatcagacaactagactttttgctccatggaagagaaaagaccaatcacaggtgacttggcatgaaattgcaaggcctcagatacatgggtatgacctgaaatgtttggcaatgattaatcggtttcagtttgtatctggagcagatgaaaaagttcttcgggttttttctgcacctcggaattttgtggaaaatttttgtgccattacaggacaatcactgaatcatgtgctctgtaatcaagatagtgatcttccagaaggagccactgtccctgcattgggattatcaaataaagctgtctttcagggagatatagcttctcagccttctgatgaagaggagctgttaactagtactggttttgagtatcagcaggtggcctttcagccctccatacttactgagcctcccactgaggatcatcttctgcagaatactttgtggcctgaagttcaaaaactatatgggcacggttatgaaatattttgtgttacttgtaacagttcaaagactctgcttgcctcagcttgtaaggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcgagccagtttttagtctttttgccttcaccaacaaaattacttctgtgcacagtagaattatttggtcttgtgattggagtcctgacagcaagtatttcttcactgggagtcgagacaaaaaggtggttgtctggggtgagtgcgactccactgatgactgtattgagcacaacattggcccctgctcctcagtcctggacgtgggtggggctgtgacagctgtcagcgtctgcccagtgctccacccttctcaacgatacgtggttgcagtaggattggagtgtggaaagatttgcttatatacctggaaaaagactgatcaagttccagaaataaatgactggacccactgtgtagaaacaagtcaaagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatgg

SEQ ID NO: 1765 - DNA, 3655 bp, Homo sapiens
gttggagcggcgctgctcggccgcggacacacgagggacgcgcccgaggagctgcaggtggcagcccaggcggtccgaacccgtcggccggccgagcctggagtattgcctaagtgtaatcttgaacatgggcggtgctgtgagtgctggtgaagacaatgaagagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtccttttggtgtgaaccatggggtggaacttcactcagatgtgatagagtatgcaaagcagaaactggacttcttcatcagaacaagtgatagttttgacaagtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaagttgactaagataacacgcacaggtccttcagcttgggaaaccaaaaagattcttgctgtttcttttgctcctctgatccagccctgccattcagagtcaggaaaatcaagacttgtccagttaccaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttttaggacatcttttgatacctttaaaagaaccactgtcaagtaatccttaaaaaaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgc

SEQ ID NO: 1766 - DNA, 4098 bp, Homo sapiens
atgctgcaaatgccgaagttaaatgaaatacctccggggagggcaggccgcagggaggctcggggggagggaagatggcctggacaaacaggtcctgaagctgcgaggctggagtggagggcgcaggggcaggcgggcggcgccagagctccatgggacagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgagagctcagtgcctctgatgacagctccctgtcagatgggctcctcctggaggaagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgtgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgaccccactcactggaccgccaaggagctttccgggtcaggagcctgccccttgggagagagggcttcggacgagccctgggaccccgggcacaggtgcccacagtttgtgtgctgtggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctaagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctggacatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttctgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggtttttgaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctg

SEQ ID NO: 1767 - DNA, 1595 bp, Homo sapiens
ggttggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagctttcagaggcagtgacatccgtgtcagtgtcggatgaagccatcacccagaccatgggccgctgctgggatgagaaccagtacttgctgtgcccccactcagcggtggccgtgaactaccattaccagcagatagacaggcagcagcccagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggacccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtgatgg

SEQ ID NO: 1768 - DNA, 2331 bp, Homo sapiens
aaaaacaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagggattttgcagatacctggaaaaacaattcagtgacttaaagcagaaaggcatcgtgatcagttttgacgcccgagctcatccatccagtgggggtagcagcagaaggtttgcccgacttgctgcaaccacatttatcagtcaggggattcctgtgtacctcttttctgatataacgccaaccccctttgtgcccttcacagtatcacatttgaaactttgtgctggaatcatggtaactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggagcgtgaacagggagacaaaggtgaagtttgtgcacacctctgtccatggggtgggtcatagctttgtgcagtcagctttcaaggcttttgaccttgttcctcctgaggctgttcctgaacagaaagatccggatcctgagtttccaacagtgaaatacccgaatcccgaagaggggaaaggtgtcttgactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgtaggatagccactttttaggtatatgtacatttatatttctatcaattccttagaaagtaaaataaatgaatagatc

SEQ ID NO: 1769 - DNA, 1680 bp, Homo sapiens
agagagctgtttactaggcacgactgcgaaggcaagggggcaccagctcaggactgcatctgcctgccatttcccttccactcctcctttctggagtctgacattagaaagccagcgagaaggaagattcaaacaaccaaccctgatttcctgcttctccttttcatgagtgttcctgtggtctctgcacctcctttctgtcccccggcagagggcagtagagatggccggcccaaggcctcggtggcgcgaccagctgctgttcatgagcatcatagtcctcgtgattgtggtcatctgcctgatgttatacgctcttctctgggaggctggcaacctcactgacctgcccaacctgagaatcggcttctataacttctgcctgtggaatgaggacaccagcaccctacagtgtcaccagttccctgagctggaagccctgggggtgcctcgggttggcctgggcctggccaggcttggcgtgtacgggtccctggtcctcaccctctttgccccccagcctctcctcctagcccagtgcaacagtgatgagagagcgtggcggctggcagtgggcttcctggctgtgtcctctgtgctgctggcaggcggcctgggcctcttcctctcctatgtgtggaagtgggtcaggctctccctcccggggcctgggtttctagctctgggcagcgcccaggccttactcatcctcttgcttatagccatggctgtgttccctctgagggctgagagggctgagagcaagcttgagagctgctaaaggcttacgtgattgcaagggttcagttccaaccatagtcagaggtggcacatctgctcagccatctcattttacagctaacgctgatctccagctccagcgatggaacccactacagaggaggtggggcccctgtgtcaaagaggccgaggggcagcaagggcagccagggcacctgtgacttcttagtacaagattgtctgtccttcaggacttccaaggctcccaaagactccctaaaccatgcagctcattgtcacaccaattcctgctttaattaatggatctgagcaaatcttcctctagcttcaggagggtggggagggagtgattgccgtcatggggccagacttccaggctgatttgccaaatgccaaaatgaaacctagcaaagaacttacggcaacaaacgaggacattaaaagagcgagcacctcagtgtctctggggacatggttaaggagcttccactcagcccaccatagtgagtgggccgccataagccatcactggaactccaaccccagaggtccaggagtgatctctgagtgactcaacaaagacaggacacatggggtacaaagacaaggcttgactgcttcaaagcttccctggacctgaagccagacagggcagaggcgtccgctgacaaatcactcccatgatgagaccctggaggactccaaatcctcgctgtgaacaggactggacggttgcgcacaaacaaacgctgccaccctccacttcccaacccagaacttggaaagacattagcacaacttacgcattggggaattgtgtgtattttctagcacttgtgtattggaaaacctgtatggcagtgatttattcatatattcctgtccaaagccacactgaaaacagaggcagagacatgt

SEQ ID NO: 1770 - DNA, 2334 bp, Homo sapiens
ctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagcttcaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggaggccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcgcacctgtaatcccagcactttgggaggctgaggcaggtggatcacctgaggtcgggagtttgagaccagcctggccaacatggtgaaatcccatctctactgaaaatacagaattggccgggtgtggtgtcacgcgcctgtggtcccagttacttgaacctgggaggcggaggttgcagtgagccgagattgcaacactgccactccagcctgggtgacagagcaagagaccctgtctcaaaaaaaaaaaaaaaaaaattaaatgggtagtgacgttaagagatatatatcagcttctagtaaaagtttttttttttaaacctgctagctacatttacattatgtaaaaataaatggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgcgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactcaggaagctagagcacgagaattatgtgcatcctggaggtgaaggttgcagtgagccaagatcacaccactccactccagtctggacaacagagtgagaccctgtgtc

SEQ ID NO: 1771 - DNA, 1529 bp, Homo sapiens
atagtctacacagagctccccttgctgcccagacaagctgaaggaccacaggaaaagccatggagacttcagcatcctcctcccagcctcaggacaacagtcaagtccacagagaaacagaagatgtagactatggagagacagatttccacaagcaagacgggaaggctggactcttttcccaagaacaatatgagagaaacaagtcttcttcctcctccttctcttcctcctcatcctcctcatcttcttcatcctcctcctcctcaggtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttccatgtggtctgaatgttggcaccagcccgggcaggggcatctcatttgggcagtactgctgtgcaacccagctgcaaggatggaaggcagagggtgggtgtggggcctgaggcttcacagtacctggaccagcaggaagattctgggaggtcactgctctcagaggacagcaagggaccctgagctctgcaagctgtgatctgtctgggttcatggtttttctcaaatcccaggctatctgcatgcgctctcaggtgctaccgagccatcctgggagagatggatggtccactgctttgaggcagggagccatcgggctggggccccttggtgaacctgatgcaggtaagatgctgaggactaaaaccattttttttgcacccaaaaaaaaaggcaggaaaatgatcatcagaaactaaatggcagccaggcatgggggctcacgactgtaatcctcgcactttgggaggctcaggctaagggtcgcttgaagctgagagttcaagaccaacctgggcaacatagtgagacccccatctctacaatttttttttaatgaccaaatgtggcggtacatacctgtacatacctgcggttccagctactcaagaggctgaggcaggaggactgcttgagcccaggagttcagggctgcagtgaggtacgatcaagccactgcactccagcctgggcgacagagcaagatcgtttctctaaaatt

SEQ ID NO: 1772 - DNA, 1926 bp, Homo sapiens
agagaggggtgcaagatcctgatttttcaggagttcaagcgacaatggcagcccaatacggcagtatgagcttcaaccccagcacaccaggggccagttatgggcctggaaggcaagagcccagaaattcccaattgagaattgtgttagtgggtaaaaccggagcaggaaaaagtgcaacaggaaacagcatccttggccggaaagtgtttcattctggcactgcagcaaaatccattaccaagaagtgtgagaaacgcagcagctcatggaaggaaacagaacttgtcgtagttgacacaccaggcattttcgacacagaggtgcccaatgctgaaacgtccaaggagattattcgctgcattcttctgacctccccagggcctcatgctctgcttctggtggttccactgggccgttacactgaggaagagcacaaagccacagagaagatcctgaaaatgtttggagagagggctagaagtttcatgattctcatattcacccggaaagatgacttaggtgacaccaatttgcatgactacttaagggaagctccagaagacattcaagacttgatggacattttcggtgaccgctactgtgcgttaaacaacaaggcaacaggcgctgagcaggaggcccagagggcacagttgctgggcctgatccagcgcgtggtgagggagaacaaggaaggctgctacactaataggatgtaccaaagggcggaggaggagatccagaagcaaacacaagcaatgcaagaactccacagagtggagctggagagagagaaagcgcggataagagaggagtatgaagagaaaatcagaaagctggaagataaagtggagcaggaaaagagaaagaagcaaatggagaagaaactagcagaacaggaggctcactatgctgtaaggcagcaaagggcaagaacggaagtggagagtaaggatgggatacttgaattaatcatgacagcgttacagattgcttcctttattttgttacgtctgttcgcggaagattaaacttaatgaaaatctgtttgtattttctgcatattctctggcaaccttgccccatacttacttatttagcatagtcgagtgctctagtttctgtctctcaggcactcgtaactaaggaccaccattggccattggtagatgtttgattgacttaacaagagagggacaaattttcaatttgtgaaactccaaagcagaaagtattggtgcttgctaccttgtgaattcttccttagacatgcagagaaaatgtatgcaagagaccaaaaagatggctccaagctatgtcatgttacctgtaataaaatcttttcttctagattctctctatgttggcagataatctccccttgtagcttccactcacttattcttgcattcagagtcacaatgatcatcttacccatgtggtttttgagaaagaaagatcaattctttgtttgcagtgggtaatcttagagatggagatgattgtagaattattcctagatgagtgtcaatttatttaattccattgtcatataaggagtcaaattgtttcttatcatttgttcattgaagaacagagacctgtctggaaaatcgatctctacaaattcaattaaataatgatccccaaatgctgaaaaagtgaaatacagcaattcaacagataatagagcaatgtttagtatattcagctgtatctgtagaaactctttgacgaacctcaatttaaccaatttgatgaatacccagttctcttcttttctagagaaagatagttgcaacctcacctccctcactcaacactttgaatacttattgtttggcaggtcatccacacacttctgcccccactgcattgaattttttgcttatgttgtttataataaaacttttcaattatctc

SEQ ID NO: 1773 - DNA, 2499 bp, Homo sapiens
gtgatccctgcgcgcgtctcctgctcgggtcagtgcgccgcgctgcgctgggcgccatggcgctccccggagcccgggctcgcggctgggcggcagcagccagagcggcccagaggcgccgccgcgtggagaacgcaggagggtccccgagtcctgagcctgcgggccggcgcgcggcgctttacgtacactggccttactgcgagaagcgctgcagttactgcaacttcaacaagtacatccctcgccgcctggaggaggctgccatgcagaagtgtctggtgaccgaagctcagacgctgctgcggctcagcggggtgcaacgggtggagtctgtgttctttggtggggggacccccagtctagccagtccccacacggtggctgctgtcctggaggctgtggcacaggcagcccacctgcctgcagacttggaagtcacattggaggctaatcctacttcagctccgggctccagactggcagagttcggggcagcaggggttaacaggttgtctataggcctccagtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatggggcgctcagtacccacaattggacttactggcagtgtggtcagtaccttggcgttgggcctggggcccatggacgatttatgccccagggggctggaggccacacccgggaggctcggatccagacactggagcctgacaactggatgaaggaggtgatgctgtttggccatggcacccggaagcgtgtccccctgggcaggctggagctgctggaggaagttttggccctggggctacgcaccgatgtggggatcactcaccagcactggcagcagtttgagccccagctgaccctgtgggatgtgtttggagcgaacaaggaggtgcaggagctgctggagcggggcctactgcagctggatcacaggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccaggggaatggcagcagtgaggtagatgggaggacatttctggtcagggaactggcatcccattcagcatctcaggactcacaggccaacatgtgttccatggctgggaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatattagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 1774 - DNA, 1720 bp, Homo sapiens
gactgcagatgaaattagtaactggtggggtcgtggggtgtgaatggtgggcgggagcagctatgtcagttggtgtgtttctgcttatgttagggtaattgggcacggcctttgtgtaactggtgaatatctctgaacctgggcatgaaacagagagatgtcctaactctgggtgagaggaatcctcatttttctctgccctctcactgtggcatcctaagaaaaaagttttgggttcctgcagcatgaaggagagctctgctcccagaatttgggagctccagatttcttccagggtgtggaggcatcaatatatcagtctgggaaaggggttcctgggccactccaggagctgagttgggtggaaggtgctgagagtgtgggtgggggccacttctgagcacccatgtggcacccactgctggtccctgtttgtggctgggcactcaggaaaatgtttttggtgctaagagtaaaaagccaaccaacaaacacatctcttttttctgtctattcactggaaagtaaaagcagtctgggcgcaggctggggacccagatggaattcaaacttatgcctgctctcaaggtgctcacggttgctgataaacagctggataaaatgaagagtctatgagtgagggatgcagagccagggaaggctggtggagtgatgccaccagcacaggggtatgagtttgcagctgccaaggggccaagggatgagctggggccctccttcccaatggcatctccccctggtctggaactgaagacactgagcaatggtccccaagccccaaggagatcagctcccctgggcccagtggccccaaccagggagggtgtggagaatgcctgcttctcctcagaggagcatgagacccatttccagaaccctgggaacacgagactgggcagctcacccagtccccctgggggtgtctcctcactgccccgatcccagcgggatgatctgtcccttcattcagaggaggggccagccctggagcccgtgagccgcccggtggattatggctttgtttccgccctcgttttcctggtgagtgggattcttctggtggtgacagcatacgccatcccccgtgaggctcgagtcaatccggacacagtgacagcgcgggagatggaacgactggagatgtactacgcccgcctaggctcccacctggacaggtgcatcatcgcaggcctcgggctgctcacggtgggcggcatgctcttgtcggtgctgctcatggtctccctgtgcaagggcgagctgtaccgccggaggaccttcgtccccggcaagggctccaggaagacctacggctccattaacctgcgcatgagacagctcaatggggatgggggccaggccctggtggagaatgaagttgtccaggtctcagagactagccacaccctccagaggtcttaagaactagcccaccttatctggctgctttagctccagtgctacaaggtccaccccctgctcccgcccacctgacccctgccaaggccctggggttttaaactgagctcacatagggccttgtggaagaagtactgggtgctggagggagagctcggggcccagcccatgccccacacgggcaagcagcccactgatctgttttgtagctgaggttttgcatacggttttgtttggaggatggcttctgctgctaaaaatacaaaagtttggaaaccgc

SEQ ID NO: 1775 - DNA, 1403 bp, Homo sapiens
aaaggcgtgagcgcgcgtgcgtgcgtgtgcgggtgcgtgagcgtgagcgcgcggaggccggaagcgagcgctgcgcagtcgggtggtcgcgggccatggagggtagcttctcggatggcggagcgctgccggaggggctcgcggaagaggccgagccgcagggcgccgcctggagcggggacagtggcactgtttcccagagccacagcagcgcctcggggccgtgggaggacgagggcgcggaggacggcgcgccgggccgcgacctgccgctgcttcgccgcgccgctgcgggctacgccgcctgcctgctgcccggggccggggcgcggcccgaggtcgaggccctggacgcgagcctagaggacctgcttaccagagtggacgagttcgtgggcatgctggacatgcttcgcggcgactcgtcccacgtcgtcagcgagggcgtgccgcgcatccacgcgaaggccgccgagatgcggcgcatctacagcaggatcgaccggctggaggccttcgtgaggatggtggggggccgcgtggccaggatggaggagcaggtcaccaaggccgaggccgagctgggcaccttccccagggcgttcaagaagctcctgcacacgatgaacgtgccctcgctctttagcaagtctgctccctcgaggccacagcaagccggctacgaagcccccgtcctgtttcggaccgaagactacttcccttgttgcagtgaaaggcctcagctctgacggcctgaccactgcggcaagaggaccccagctggggtgcttacctccagtatgaagtgaattgcaaatcctgcttatggacatatatgatgttggagtgtgggattttaaagtttactttctacaaactctccgtagtatattcatgattcagtgtagaatgtatagactttatgtcttccaagtttaaaaaaagagacagggtcttggtatgttgcccagactgttcggaaactcctgggctcaagtgatccttccacctcagcctccccagtagctgggactacggggtcgccactgcacccagcctgtgtcttccagctctaatcagaaagctgcttgtcgagggcatggggaatcaaactgaatgaacttttctctgcactgtggcaaaactgttatttttatggattttactaaatggcgttaccttttcaagatttatatgtttgtataatcataagaaaattgagccattaaagccttgttattcaatcctaatagtcagttttctagaacctacttttagggtaaatggtacattatttaatattatattgaacctcctatagcgtggattgtagaccaaaggaaatggtacaatttctgagaatatatgttgattttttgtgactaattccaaagttgtatttg

SEQ ID NO: 1776 - DNA, 2835 bp, Homo sapiens
gtacagaagcaaaatcaaacctgctatttcagcactcctgtttttaacttggtgtctttagtgcttggattggtgggatgtttcggaatgggcattgtcgccaattttcaggagttagctgtgccagtggttcatgacgggggcgctcttttggcctttgtctgtggtgtcgtgtacacgctcctacagtccatcatctcttacaaatcatgtccccagtggaacagtctctcgacatgccacatacggatggtcatctctgccgtttcttgcgcagctgtcatccccatgattgtctgtgcttcactaatttccataaccaagctggagtggaatccaagagaaaaggattatgtatatcacgtagtgagtgcgatctgtgaatggacagtggcctttggttttattttctacttcctaactttcatccaagatttccagagtgtcaccctaaggatatccacagaaatcaatggtgatatttgaagaaagaagaattcagtctcactcagtgaatgtcgcaggccatttctaaaagtgctacagaggacagacagggttttgaggccaccctgattattgggatgcatctgcagcacatccaggacttgaatttcattacgagttcctaatagttgtatttctaaagatgtgtttcctagagaatgtacagccttatgacactgtagtgatgtttttataattttctaagtagatttttttatattaacaaattcatatacagaaaaaataaggtgttacaaaaaatggagagctcttatttttgtacagattctgtcgtttttttttatttgtgtgagatttatggaaatacactaaatgagtaattcaggttcagtacatttattacaaagtgaaatcaggggatattcatttgtaaattttattcttagtgaatgaactgtataattttttttatcaggagagcacttataaaattcaatttataaagatcatatacccaaatcataaagatttagttgatacattaacactaagatactctgatttttagcgaactaaacaaagtgcttctactgagaggcctttataccaccatgtacagtaactctaagtgaatacggaagaccttggttttgaaattctgccaccttgtttctccctgctcatgaggtcgcaccttttgctcttgctgctaattgcccattcgtagtgggtgtaatgccaggtggaatggtttcaacaagtcaggtgaaaaccatcctttattgttgctggcacaacttgatatatagtctgactcagaactgaagctcacatctcaaattcatttcatgccagtaaatgtggcaaagagaagaaaggcccaagagcgagacaagaagaatggagaagggggcagccaagaagaacttctgggttcagggtactgtttatttgctccttctcttcatgcctgtggctggatgtcccacaacactataagaaatataagtcaagccctttgtgttaagcaagaactacagactccatcttttcacccaaatcatgaatgaccaataaaaagcaagttattccagaggaagaagcagcccttgaaatgttaaggcttaggcttgaaaggtgaagagcaggaattctctctttcaaatcctagagcataaacccatgtgtggccaagtgagatcagccctcaagggcacatgccaagggcagagcagcccatgtagacagcttcggagggcatgggggtgtagggagttcggggtagctcctcattaactatttgttgggtgagtaaaggggtgaggctcagtggcaggtacctctgcaatgacaagctgcctcccctctatgtgtttagcatatgttattagaacatgtccgacacccctaccgctgccatttgggccctttaataaagccaagtagagaaatctggcaataaaaggcaaatgtaagcatgctttctttaagacgcatcataaatggttttctttaagtgaatggaagagtttgacagagatacacctttgtaagaaaacattaagaatgctggctggctgtggtggctcacacctgtattcccagcactttgggaggcctaggcaggaggattgcttgagcctgggacttcgagaccagactgggaaacatggcaaaatcccatctctacaacaaaaatacaaaaattagccaagtgcggtggtgtgcctgtagtcctagttacttgggaggctgaggtgggagaatcacctgagcccaggaggtggaggctgcagtgagccatgccaatgcactccagtctgggcaacagagtgagaccctgtctcaaaaataaataaataaataaatgaataaagagaatgctaatcatttctgggttcactgcgactcactgtagtgctggggatcccccttgtaacactggaactgaaaggcagtgatgaaagctatgtcaagcattcattattctgaagaggaggagaaatgccacatacctttcccatgggacctgtggtggaatgaatccatacttctgcctcacttcgagcagacttttgttctcggcgctcctcacgatggagtttcatgcttcattttcacatctctctgcacaattagattgggagctccttgagggcagagtacgtgccttaatctttatctttgtaatgccacaatgaacagagtgcctcctggtacactgtaggagcttaagaaatactcactgaatgcatgaatgaatgaatgaacaaatgaaggaatgactaaggatgtttgtagtgctataatatagaatgggatttactctgctttaccagttagtttcataataaacaaatagtctgt

SEQ ID NO: 1777 - DNA, 1354 bp, Homo sapiens
gggcgcagcgccgagattgattcaccttcacctgtgctgcactccagctgacccaagtaggaagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcggcaaatggccaagacctaaagaacctgctgcaccaggatgctgtagacctctttcgtaatgcaggctatgctgtgtctctgagagtgcagcacaggttacaggtgcagaatggacctataggacatcgaggtgaaggggacccaagtggtattcccatatttatggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaaggtattgtttgaaggaaaactgaagaaaagacttggcttagaacaaatgaggagttatatattttactaggacttttgatagaaattcagctacaacccaaagagagaaagattgagtcttcctgtcaccataggcaataccttttttcttagctggcatgccataaaggccagctatgtgatattagaggaagaaaggatttttctttttaatgatcttccttgggaaattattgtggcctttatttaatttctaactacgtacctgggtgcctatatcgacaaagagtgagaagagcatttttacctttttaaaaaagcaaatacatatatacacatacgtatgcaaatattatagtataatagtgatccctatggagaattaaaggtgagaaagctactttgtggtgtctaggtttctgataaaagggatgatcttaactgaagaatttaaagagatacttaaacagagcaaatgtagtaggaacaagggagtgagccttataagaggacgttcagtctcatttattaaaataataactgagactgggagaggtggctcatgcctgtaaatcccagcactttggtagcctgaagtgggagattgcttgagtccaggagaccagcctgggcaacatagcaaaacctcatctctattt

SEQ ID NO: 1778 - DNA, 1891 bp, Homo sapiens
tgaaaaccagcttgtagttagggcccggagcgcatgccatagactcggcgactcaggaatcctgaagactctctgagcgacctggagcaccttggctgtgtccctgcctgccttcaccctcctccagtgcccccagtactgggcgtgagtccggaagtggccacaacccagcctggaccgtcgcttataaagctgtgtaaacctgtataagctcaggcgttgacagctggaaggcagctggcactggcagcccccttcattgcacctatctcccccatctcattgccacggctgaaccctccttctcaatcttggaacagcacccccttctttaagtcccccaggacccgacagcctgagccagatttctactgtgtcaagtggatcccttggaaaggagaacagacacccatcatcacccagagcactaacggcccttgccctctccttgccatcatgaacatcctctttcttcagtggaaggtgaagctccccccgcagaaggaagtgatcacatcggatgagctcatggcccatcttggaaactgcctcctgtccatcaagccccaggagaagtcagagggacttcagcttaattttcagcagaatgtggatgatgcaatgacagtgctgcctaaactggccacaggtctggatgtcaatgtgcgattcacaggcgtctctgattttgagtatacacccgagtgcagtgtctttgacctgctaggcatacctctgtaccatggctggcttgttgatccacagagtcctgaggctgtgcgtgcagttgggaaactgagttacaaccagctggtggagaggatcatcacctgcaaacactccagtgacaccaacctcgtgacagaaggcctgattgctgagcagttcccggagaccaccgcggcccagctgacctaccacggactgtgtgagctgacagcagctgctaaggagggtgaacttagcgtctttttccgaaacaaccactttagcaccatgactaagcataagagtcacttatacctactggtcactgaccagggctttctacaggaggagcaagtcgtatgggagagcctgcacaatgtggatggagacagctgcttttgtgactctgactttcacctgagacattccctgggcaaggggcctggagcagaaggtgggagtggctccccagaaaagcagctgcaggtagaccaggactacctgattgctctgtccctgcagcagcaacagccacgaggcccgctggggcttaccgacttggagctggcccagcagcttcagcaagaggagtatcaacagcagcaggcagcgcagccagtgcggatgcggacgcgggtcctgtcactgcaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccacccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggc

SEQ ID NO: 1779 - DNA, 1812 bp, Homo sapiens
gttcccaatcagtttccagccaacaccagggtgtcctagtccgcagaggtgtgggggacacactccataatctctacttttctttttgtgcagctgagtcatggagctttcagccccagcacatggctcctccttaactgcgtctgctcaacctccctcagccctgtgaacagcatccccgcacacagacgcagagcaggactctctctgctgccacttcaccttcctgagagaggaccagcggccagagcctcagtgactgccaccctggaggacagggcacaacaaccgtttctgaagagaatgggaggattccagaggggcaaatatggaactatggctgaaggtagatcagaagataacttgtctgcaacaccaccggcattgaggattatcctagtgggcaaaacaggctgcgggaaaagtgccacagggaacagcatccttggccagcccgtgtttgagtccaagctgagggcccagtcagtgaccaggacgtgccaggtgaaaacaggaacatggaacgggaggaaagtcctggtggttgacacgccctccatctttgagtcacaggccgatacccaagagctgtacaagaacatcggggactgctacctgctctctgccccggggccccacgtcctgcttctggtgatccagctggggcgtttcactgctcaggacacagtggccatcaggaaggtgaaagaggtctttgggacaggggccatgagacatgtggtcatcctcttcacccacaaagaggacttagggggccaggccctggatgactatgtagcaaacacggacaactgcagcctggaagacctggtgcgggagtgtgagagaaggtactgtgccttcaacaactggggctctgtggaggagcagaggcagcagcaggcagagctcctggctgtgattgagaggctggggagggagcgagagggctccttccacagcaatgacctcttcttggatgcccagctgctccaaagaactggagctggggcctgccaggaagactacaggcagtaccaggccaaagtggaatggcaggtggagaagcacaagcaagagctgagggagaacgagagtaactgggcatacaaggcgctcctcagagtcaaacacttgatgcttttgcattatgagatttttgtttttctattgttgtgcagcatactttttttcattatttttctgttcatctttcattacatttaaatctctggaccctggagcacttctaatgtatcaccccatggagtcattgttctaataatcaccaattcagactcagatcctcgtggtctatggagcatgctgcttgctgtctgtgcagctcccatttccccttcttcctgatagacttggagctgtgtgcctccactccaaggctgcctgcctgctgtaaacactattccactctgtctgccaacaactgcttcaggaatgggcctgagatcccatgcaggtccctgagaagtgagtaaaagtccgcagaggtggggatggaagatctctccttagatagaacctgtcttcctccctggcattgtggggtctgggcgtgacactgggactctcagcagctttgtgctgccaacctgagattgaaggcagtgcctcagagcagcacagagagttggggccccctgagccctgagccaccagccctgcagcctgccctatctccgcatttccagttgtattagccaatagatttcctacttatttaagctatttgagctccgggtctcttctacctgcattctaaaacattcaaagtaataaaaatttctccacatt

SEQ ID NO: 1780 - DNA, 1432 bp, Homo sapiens
gcgggcgcccagtgcaccggaggaggtgagcgccaggtcgccttcgcggcccggggacacaggcagggacgcgggagctgatgcggctggaccggccggggaaacagtattttctggaagggggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgaccttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatgaagaagactccggaggagcccagccccaaagacagcgagaagagcgccatgggggtgtgagcaccacaggcaccctggatggcccggccccggggcccgtacacaggcggggccagcacagtagtgaaggcggtctcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgcc

SEQ ID NO: 1781 - DNA, 2087 bp, Homo sapiens
gttttttaggaagagtgtcccgcagagacccggcgggagctgccaggagctctgggattccagcggctggaagccacctgggaagcctggcctcagtgtggaagagaaggcagcaggattattacagaaccttgtgaagccaacgcgggcagccgccaggagctgcagaccgagaggatctcgtcctttcttgcggcccagggagaccaggcctttcattctgggctcgagaccaacaattcgaattccgaactccccctgcgtgtgggactcaaggttgcccagggctcacctctgatgggtgggcaggtgagcgcttccaacagcttctcgaggctgcactgcagaaatgccaacgaggactggatgtcggcactgtgtccccggctctgggatgtgcccctccaccacctctccatcccagggagccacgacacgatgacgtactgcctgaacaagaagtcccccatttctcacgaggagtcccggctgctgcagctgctgaacaaggccttgccctgcatcacgcgccctgtcgtgctgaaatggtccgtcacccaggcactggacgtcacagagcagctggatgccggggtgcggtacctggacctgcggatagcccacatgctggagggctcggagaagaacctgcactttgtccatatggtgtacacaacggcgctggtggaggacacactcacggaaatctcggagtggctggagcggcatccacgcgaggtggtcatcctggcctgcagaaacttcgaggggctgagcgaggacctgcacgagtacctggtcgcctgtatcaagaacatcttcggggacatgctgtgtcctcgtggggaggtgccgacactgcggcagctgtggtcccggggccaacaggtcatcgtctcctatgaagacgagagctccttgcgccggcaccacgagctgtggccaggagtcccctactggtggggaaacagggtgaagaccgaggccctcatccgatacctggagaccatgaagagctgcggccgcccaggagggttgttcgtggccggcatcaacctcacggagaacctgcagtacgttctggcgcacccgtccgagtccctggagaagatgacgctgcccaaccttccgcggctgagcgcgtgggtccgagagcagtgcccggggccgggttcacggtgcaccaacatcatcgcgggggacttcatcggcgcagacggcttcgtcagtgacgtcatcgcgctcaatcagaagctgctgtggtgctgacgggacccttctgaagttcgggacgcggcggctgcagtttcacccccgaatttccaaatggagtttcgctctcgttgccgaggctggagtgtagtagtgtgatcctggctcactgcaacctccacctcccgggttccagcaaattctcctgcctcagcctcccaagtagctgggattgcaggcgcccgccaccacgcccggataatttttgtgtgtttagcagagacggggtttcaccatgttggccaggctggtctcgatctcctgacctcaggtgatccacccgcctcggcctcccaaagtgctgggatgacaggcgtgagccaccgcgcccggcctatacctcattttctacatgtcgcttgttggagctgctggttcaagttcccagccagccaatggatgccagcaccatttttactcccctttcccaagcaaatcgtgcatttttgtctaacgagagacatcagtttctcaggatgatcctcaagaacgttatggagtccatgttgcaataggttctctttgggacctaatgactcattttccaaaaatccgcttctacttttggtacccggttgctacggtgaaatgaaggtgccccgcatccagaaagacgcactcctggaccacaaccggcggctacctcagccccacggctctgcaggatcagggctcgggcaggccccgcggagatgaagaatttgcagggagcctccctgacttccgtcggctgtgaatccttgtctgtcaggggcgtatccacaaaatcaccaaattcatacagatcgtttaaataaatgaacatcattaaagtc

SEQ ID NO: 1782 - DNA, 3224 bp, Homo sapiens
gtcccacatcccgcatccggcatcccagcggccgggcatgtagcagcggcagcaacggcggaatatgggcgggaaccactcccacaagccccccgtgtttgacgagaatgaggaagtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtcctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctgatctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttggacattccttc

SEQ ID NO: 1783 - DNA, 1704 bp, Homo sapiens
atgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatctgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaaaaaaaaaaaaaaaaaaaa

SEQ ID NO: 1784 - DNA, 2886 bp, Homo sapiens
tgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagcatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaaaaaaaaaaaaaaaaaaa

SEQ ID NO: 1785 - DNA, 3683 bp, Homo sapiens
cctggcaggcggcggctgcagggcaggtccaggggccacatggctgagggggacgcagggagcgaccagaggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcggttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagatcgctttaaacatatcaacaactgtgccagaaacatactagtggaaaagaactacacaaattcacctgaggagtcatctaaggctttgggaaagaacaaaaaagtaagaaaagacaagaagaggaatgaacattaatacctgaaactataggaaaggttaatttgcctataattatatatacattccatagtcatcaaggaatatattgtgcagagagagtatccttgactgcttaagtcagccagttcagcatggataccaacattagcttttcttcttggttatatcatctgccaaaaatagagaacttatgatctattcatgtgtgtttcaggcttatttgggagaactaatttgaacttaatcaccacttcatctaattttagcaaggtaacagttgcccagggcagtacctgaattaactgtccatttcagtacatgtcaagtgcctttgttaggtggagaagaaatgtctctagaggaatataaatacctgatttcttgtcatcgagattcttgtactgttaaatgaatattgccttttactgctctttatggcttattggaataggagctcatttaagattgatcttggagagtttcttcttgtgattttagttcataagtatgtcacctttcattttatagtgttcatcattgagtaatggattaagtgaaaatccaggagtatccatctgcagttatgtgctgaggtgataattcatccaacatatttgttagcataaatattatgcttcagtttctgttgcaaattggtgattgtgaaattacagaaagtgattttctagtctgctttttttgtttaattcttgtaatgtaagcaataaatatggagtgtcagtagtctccttccaccccagaaatgtgttggtgtaacattctcgtttcttttaacaacctggaagtacctttcttgtgatcttcactgaggaattagaactatgatagaagttaggctgtggcaaatgggacattcgtagagtgggatagaggtggcagaatgaacctggtgtagggcaggagtatgttgtgtagttacatcaatttgatgcatgctttccatctgcactccagacggctttctcagttccaagattttgcagagagaaggagcaaaccttttcattggaaaaacagaaacaaccctcccccccattttttcccctctattcatcaaacctttatgtatctttcatcttccagttacctctaggcatttagatagtgaaatttacctttgagatataacaataagtgattaactgttcactttcagatgtaatggcaaacaattgttaaaagttattaactgatcacagatttgcctggacttcccttcccagggagggaacagaagttaggaggcaactttgggatggtgctagagcatggaaagcacagagaattggacaaacaggtctttttctcttttctctgatgttttacctttaaaagatccaacatccttaccgttggtatttttagtaaggttatagtaaatagctttacaccaggatggattctgaaatataaattctaaattatatttgttataactatattttatgttgtatgttatcaggagccatcagagaatgacctttttgtgtttggaacacttggttccatgaaaagtatgctttgtgttttaactgttaaaataatttaaaaattaattattttacataattaaagaagttaaaaactattaacattaaataatttcacaatttcaacatgtcaaacctatgaagggagataggaaacaatgagaaacttacttttgctcctttatacagaattattaactatattttactaactaaaaaactctagtattctttacctaaagtcaattggctggtaagagggagagatgcaaaattctccagctctgaacttggagctacttcacactctactcttaatggaaacttgaactaatgatagatagtatttttttcctctatttaaaatttttgtcttgattaggagatttttcagttctccatataataattttctacaatcagatctatgctgtggcatattttgctttatttaaaaatttttttttagagatgagttcttgctctgtcacctaggctggagtgcagtggcatgatcatggctcactgcagccttgaccttccagcctgccaagtagctgggattacagacaggcatgtgctattacacctggctaatttttaaagttttttttgtaaagatagggtctttctatgttgcccaggctcgtcttgagctcctggcctcaatcgatcttcctgccaaggttttggaattacaggtgtgagccaccatgcctggcctgctttgacatattttatagtgtgttaattacaaatagtcttcatatgccagaatataagagcaagtgttatctactttttagatgggaattgcagaagctgcatcaaaagtatgctttgaggtatatatagtgaaacagagcctttctgaagagaattatatcaaactaattacaaccaagaaataatagtatgaagcggatgctgtttggaggacaggaaaatttatcgggaaaattacataatccctctgattccactatccagagatagccattattattaatatttggtatgtacatccttatattattttttttttatgcatgattttgtatatatggttatttttctttccataaaaatggtattaaactgtatatactgttttgtagcctacatatttcatatagaagtatattgttaacattttccatgtcaataaatattctatggctttct

SEQ ID NO: 1786 - DNA, 703 bp, Homo sapiens
agtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctgggaaaaaataaaagaactgcaatcactactccaaactttaagaagcttcatgaagctcattttaaggaaatggagtccattgatcaatatattgaggagaaaaaaaaa

SEQ ID NO: 1787 - DNA, 1005 bp, Homo sapiens
aatttcggcacgggggggaggcacagtgagtccactggggcacggcagcgtctaagccacaagccgactgacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggacttggaggcggcgggaactgcaattggtggctttgaagggcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggatgtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggagttagaagctactgggaaaatctacctccgacaagaggagatcattttagatattaccgaaatgaagaaagcttgcaattagtgaacatgaaaggaaaataaaaattcctcacagtcaaaaaaaaaaaaaaa

SEQ ID NO: 1788 - DNA, 927 bp, Homo sapiens
ggcagcgggcgaaaggagccggggcctggaggtttgcgtaccggtcgcctggtcccggcaccagcgccgcccagtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctggaaaggcagctcatcatgcagagtgaaatgagggaaagacaaatggccatgcggattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaatcatggaggtgctctaaataacttttagatttcctctctctgtgtgcattaccaatatctaagtgtaaaattaataaattgttttgaattcctggaaaaaaaaaaaa

SEQ ID NO: 1789 - DNA, 2140 bp, Homo sapiens
gtggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcaggccagaacccctgacggtattcagctgcgcgtaagtctggccggtgccatctgtctccgcaatgccccccaagaaacaggctcaggccgggggcagcaaaaaggcggacgaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagatttgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaaccggaaaatggagccattgatgctgttcctgttgatgaaaatcttttccactggagaggatttggatgaactagaagaagaattaaataccttgatttagaagaatgccccaaccctcgctgaaaaaattaagtcagccagcacgagttgaaattgactacattaatttcctttccacctagaatcaacaggatgtttatttcctatgctgattctggaggagttacctcctgcaaaaaaggcatcttgtccctacatcttctcttctgactttggctacatctcatagtaagttcagagtagttcatgataaattgaaaatataatggtcattgcagaaaatgattgatgttgtactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaaaaaaaaaaaaaaaaa

SEQ ID NO: 1790 - DNA, 1510 bp, Homo sapiens
cgagtgtggccaagggtgccggaggcagggttcgggtgcgtagtcgttgcgtgggcgctgcccaaaaggcgcagagcatcaagtgtgcgtgggcagaaccggcgcgggcgcccgccgcgggtctgcgcggggcgggggcgcagcaagtgcatccgagcgagcggagactagcgcaccggcgtcggtggcgagggtggtgcagaggagtccggctgggcggagggaggaaggatgggtgcgggtaactttttgaccgccttggaagtaccagtagccgcgctcgcaggggctgcctccgaccgccgggcgagctgcgagcgagtgagcccgccaccgcccctcccccacttccgcctcggcacgaggcctcttcctcgttcccggctcccagggcccgtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtggctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacaaaaaaaaaaaaaaaaaaaaaaaaa

SEQ ID NO: 1791 - DNA, 1402 bp, Homo sapiens
ggcacgagcggcacgagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaaatcaccataggaatctcccagaggagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagttaaaaaaaaaattctttaaggctactattaatatgcagacttacttttaatcatttgaaatctgaactcatttacctcatttcttgccaattactcccttgggtatttactgcgtaattggaacatttactaaaataacacttttggcttaaaaaaaaaaaaaaaaaaaaaaaaaaaaaaaaa

SEQ ID NO: 1792 - DNA, 2341 bp, Homo sapiens
agtgtaagcagtgtgcaaacaaggtgttacagcacatgaaggccgtgcaggcagatcaggagcgggagaggcagcggcggctggaagtagaacgtgaggcagagaagaagcgtgaggctaagcagcgagctaaggaagctcaggagcgggaactgcggaagcgggagaaggcggaagagaaggagcgccggagaaaggagtatgatgccctcaaagcagccaagcgggagcaggagaagaaacctaagaaggaagcaaatcaggccccgaaatctaagtctggctcccgtccccgcaagccaccaccccggaagcacactcgttcctgggctgtgctgaagctgctgctgctgctgctgctatttggtgtggcgggagggctggttgcttgtcgggtgacagagctgcagcagcagcccctctgcaccagcgtgaacaccatctatgacaatgcggtccagggtctacgccgccatgagatcctccagtgggtccttcagaccgactctcagcagtgagcttgttcccagcacctgctgcctcccagccttggagtttggattcctatggaattgggttctgctggacacaacctctttttagcatcagacctacctgccatcatcaaatggctgcagattggtacatgagacctcctctttgtaggacttcttcattccttagtcagggttccctgaaggaatgaggagaaatgggaggtggcgggggggcgtggggggcagttacctgcatgcctaaaggagtaggcttgggggtggggagagagaaaacatagccttttctagttgttatataaagctgtgtaaaggcaaggctcgtttctactaaatggtcagctgtcactacatttatacttttgtatgccacaaaccctttcattcctccctgggaatcagggtagatcaggaggaactgggggggactagaacaccacgctcagtaaatccagtctaaactgggaggtaggggtattcctgttttctttaggacctcagagatgtaagcattttagcagccacacaaaatctctggctatgaaagggacttcatgaccatccagtccaatataacacttgcagacagagaaactgaggtcttccatgacttgcctagtctcccagctagtttgaggcaaaactggattcccactctggtattctttcttccctttacatcattttccctcctttataatgtcctgagagaccagaactcacaccagaatcgattattcctcaggtgaagcatagactctttcatggtagacagatttcacgactcagagatagaaatctcttgctatcatcaggtcacgggcagctcctgtggagtcctgcccaacttatgtggcttccataaaatggcaacagtccaggctccttgcctaattttagagcattaactccctaattgccagtaagcaaggaggtggatctctgcaaacctacactgtctatgacagctctagttgtacttggtgtgactaaatacctcaaaggcaacctgcttctgcaggttttgaagtgtcagcttcataagacactgaggtttagaattgtttgattctagaccataactgaagggcataaatggaaacaggatatgaagggaaacaagtagcatcatggagctgaaaagtggtgcatcacccaatggctagcacaaacaaggatcacactgtccattctcttgtctgctaaattaagcattttcttgcctcctttgcttcatcttttcacaacagctggatagagggatcagaaatgactgtgtcatggtgctcattcactgcaaactcccagttgcaagctccttggctcccccggagggagcaagaatctcatagttcagagacacagagggccttttagccctaatgaccttttggatgggactgcaactcatgactatcctgatattggaagaaaggactttgttaatcttctcccccatagctctgctgcgtaggtctacatcttactcagaatcactacacattcctttagtcttcctccaagctccagagccattggtacaaatgctttattgaaactaaatacataatacacacaatgagatgaagacaatatagaagtccgcatagtcatcataatcccgttccttggccggttgaggcagctcagtggctgagcccagtcaagccaacccgcagcttcactcacgacttcaagatttgatgctaattcttttggatttctacagttattaaataagtgtctgagtggacaaaaaaaaaaaaaaaaaaaaaaaaaaaaaaaaaaaaaaaaaaaaaaaaaaaaaaaaaaaaaaaaaaaaaaaa

SEQ ID NO: 1793 - DNA, 1159 bp, Homo sapiens
gttcatgaggctaagcctgtgccagaaaatcacccacagtgggatacagcaatagagggggatgaagaccaggaggacagtgagggctttgaagatagctttgaggaagaagaggaggaagaagaagatgatgactaagcagtactctgaatggaccacagtgtttgcacatatttgcaattttttgctgttttggaagtgtatcataaaccagaaacagtacagaactgatgttgagggaggtgtagtttttttactctagaaatgggtgcataatataactaggcagtggcggtgccttggtacaacctgaaaaatgttaaggcttattgaaacctttcaagtaggggatggtacatttatttcatctgcaaatgataataaatcctttgttattataactgtccagaagtgtgggctatgtattatctgatcagtctatggtcccagtaaaagtaaagatgcaggaaacacagtctgtaaatgagcgacttttctttgttcagctttagttttagcaaacaccacaaatatgttttaagtaacatcgctcaagtttaagtaacatcgctcaagttgataatctcttgataagctctgttgttgacattttgcagtgatacaacagctccactcatagatttaaacttttatttttacttatcttggtcataagttggcattctctcacattccacatgatatagagggctacgttttggaattttccttttcttaattgcccagagttatcagacagattataaaaatggcttttaatggcttaaaccatttctaaacctctatcttagcagatcaatgcaggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgtaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1794 - DNA, 1735 bp, Homo sapiens
aagcatgatgggttttactagaacgtttcagtgtcactaagtcacagaagaggaggacaagaagaggaattatggcagggaccagctttatcacagtggtgtgcctggtttggcagggtgctcacaacttgtttgtgggatgtggaggtatcagaagtggcaggtgaggaggagctacagatgattcagcctgagaagctcctgttggtcacagttggaaagacagccactctgcactgcactgtgacctccctgcttcccgtgggacccgtcctgtggttcagaggagttggaccaggccgagaattaatctacaatcaaaaagaaggccacttccccagggtaacaacagtttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtgccaaaccctctgcccccgtggtattgggccctgcggcgaggaccacacctgagcatacagtgagtttcacctgtgagtcccatggcttctctcccagagacatcaccctgaaatggttcaaaaatgggaatgagctctcagacttccagaccaacgtggaccccacaggacagagtgtggcctacagcatccgcagcacagccagggtggtactggacccctgggacgttcgctctcaggtcatctgcgaggtggcccatgtcaccttgcagggggaccctcttcgtgggactgccaacttgtctgaggccatccgagttccacccaccttggaggttactcaacagcccatgagggcggggaaccaggtaaacgtcacctgccaggtgaggaagttctacccccagagcctacagctgacctggttggagaatggaaacgtgtgccagagagaaacagcctcgacccttacagagaacaaggatggtacctacaactggacaagctggttcctggtgaacatatctgaccaaagggatgatgtggtcctcacctgccaggtgaagcatgatgggcagctggcggtcagcaaacgccttgccctggaggtcacagtccaccagaaggaccagagctcagatgctacccctggcccggcatcatctcttactgcgctgctcctcatagctgtcctcctgggccccatctatgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggggccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttccaaa

SEQ ID NO: 1795 - DNA, 1688 bp, Homo sapiens
tgaagtttttcgaagtagtagactctcatcagatgctacagttttgacaccaaatacagaaagcagttgtgatttaatgaccaaaactaaatcaactagtggaaatgacgacagcacatccttagatctagagtgggaagatgaagaaggaatgaatagaatgcttccaatgagagaacgttccaaaacagaggaagacattctacgggcagcacttaagtatagcaacaagaagactggaagtaatcctacatcagcctctgatgattccaatgggctggagtgggaaaatgattttgttagtgccgaaatggatgataatggaaattccgagtattctggatttgtaaatcctgtattagaactgtctgattctggcataaggcattctgacacagatcaacagactcgatagggtaaaattgtgtgaccttgtttatcagttatgaccaaatgttaaaaaccaactagaatgtataagtgattgtgcttagcctttttgtaagggagatgtgtaagaaaccatgttgtaaatgcttattttattacaaaggagtagggatgataggatctgaattgatacagaattaagtgcaatttcatcatctgccttctgcttttcaagaccaatttaatggtcctgtcatgttactgattaaatttactttgtcttgtctttatagcatttctgtttactatggtagatttccactttcaatttttaaaattaattttactttgaatgatttatgaagcctatttcattgtctaactatgaaaatattaagacttttttgttaattctcagccgatgtgaaggaagcatgaggagggatcgtcagattcagatttagaatagtgttcccgtttccagcattatttatttctatgacttctttggattttattatctaatagtaagtacagttgatgtgggtagatgactctaagaaatgctgaagtatcggcattacatgtgtttatttacatgtcctagtatgataatgttgattcaatctgaacaaaagataatataaaaataacccttcagagtttggacatttcaagttggtaataataaaaaataatatttaagaagatatatatatatatatatttagttttttccacttcattttacatgccactatattgactttaattgatatacagtattaagtttttaggtgccattatttttaaaaaattctatatttccaatgaacgatgttagattttacacagaacatattctctgcatgatttcagaaaagaaaatctaaaaaggtaatacgggtatttcaaataaaatcctttctggtatgaaaggctccattgattttattaagccttcctttaccttgtagtacaaggtgctttaatgggatagaactaagcatatcaatatctataactgcattttgtgctagacaattactgttcttttctctaaaatgtatatgtcaatttacaaggccagggatagaaaacactccataattgctttccttgattttgctgaggatttggtatgattttagtaagcaaactgttttttggtttttccttaatgtttttaattttttttcctcttgcaacaatgacggtgcatgttcttataaatataggaaggtccagatataaatagtaacctaaagttcttgctgtgcttaaaaaaaaaaaaaaaa

SEQ ID NO: 1796 - DNA, 1321 bp, Homo sapiens
ccaagctgggccagatcggccggagcaagcgggttgttattgaagatgataggattgatgacgtgctgaaaaatatgaccgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcaaaattaatatccatttctttttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgtgaaatgctgtccagttttattttttttatgttgttatccttggatgtacaaaaaattcagaaaatgatctctgtagatattctgttttattttggtcatctttagaagttatcaggaatgtgtttaaaacaagaagagaacttttctaaggaatgatacatagaaaagattttattttaaaatgagttgtaaagcgtgtgtttctttgttgctgcaagctatctgcccaagttaatgcaaatggacacattttttatgtcagaaaaacacacacacacacacacacacacacacacacacacacacacgaaaaacaaagaaaaaaatgcttgagctttttctaacttccccttgcagtctgttgtgtgagcagcctgtttatttctctaatattatgtcagtttattctctttaatggactgtaaaaaaatgtaatcacaagagtgccaaatatcttgaaatgccaaaaggcattttagtttcttttctctgtgctctgagtccacgtacaggaatgcttggagtgtcttttctgttatttatagggattctcttaaggcacaccagctgcctgttttgcatggtatttgcaaaaatgcctcttgcgtgaggaaatcttttaccattttttgtttgcaactttggacctcaagaggtttcccttcccttccccgttccctcttttcttaattcaatattctgtatgttgcaccttgaaccagcacac

SEQ ID NO: 1797 - DNA, 1844 bp, Homo sapiens
cgggcaggtggggaacctccctgaagagtgccctggtcacagcacccttgaagacagccattggccatggggacccaaccagagcctggcctgggagccaggatggccatccacaaagccttggtgatgtgcctgggactgcctctcttcctgttcccaggggcctgggcccagggccatgtcccacccggctgcagccaaggcctcaaccccctgtactacaacctgtgtgaccgctctggggcgtggggcatcgtcctggaggccgtggctggggcgggcattgtcaccacgtttgtgctcaccatcatcctggtggccagcctcccctttgtgcaggacaccaagaaacggagcctgctggggacccaggtattcttccttctggggaccctgggcctcttctgcctcgtgtttgcctgtgtggtgaagcccgacttctccacctgtgcctctcggcgcttcctctttggggttctgttcgccatctgcttctcttgtctggcggctcacgtctttgccctcaacttcctggcccggaagaaccacgggccccggggctgggtgatcttcactgtggctctgctgctgaccctggtagaggtcatcatcaatacagagtggctgatcatcaccctggttcggggcagtggcgagggcggccctcagggcaacagcagcgcaggctgggccgtggcctccccctgtgccgtcgccaacatggactttgtcatggcactcatctacgtcatgctgctgctgctgggtgccttcctgggggcctggcccgccctgtgtggccgctacaagcgctggcgtaagcatggggtctttgtgctcctcaccacagccacctccgttgccatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccggggcgtgggctatgagaccatcctgaaagagcagaagggtcagagcatgttcgtggagaacaaggccttttccatggatgagccggttgcagctaagaggccggtgtcaccatacagcgggtacaatgggcagctgctgaccagtgtgtaccagcccactgagatggccctgatgcacaaagttccgtccgaaggagcttacgacatcatcctcccacgggccaccgccaacagccaggtgatgggcagtgccaactcgaccctgcgggctgaagacatgtactcggcccagagccaccaggcggccacaccgccgaaagacggcaagaactctcaggtctttagaaacccctacgtgtgggactgagtcagcggtggcgaggagaggcgggcggatttggggagggccctgaggacctggccccgggcaagggactctccaggctcctcctccccctggcaggccagcaacatgtgccccagatctggaagggcctccctctctgccagtgtttgggtgggtgtcatgggtgtccccacccactcctcagtgtttgtggagtcgaggagccaaccccagcctcctgccaggatcacctcggcggtcacactccagccaaatagtgttctcggggtggtggctgggcagcgcctatgtttctctggagattcctgcaacctcaagagacttcccaggcgctcaggcctggatcttgctcctctgtgaggaacaagggtgcctaataaatacatttctgctttattaaaaaaaaaaaaaaaaaa

SEQ ID NO: 1798 - DNA, 2068 bp, Homo sapiens
ctgcacagggagtttgtcttgtgcaaacaatttccaaggcagcgttttcttccctgcctgggagtgcagggctcagcgccttcactttggaactgactcagagacctaaagaagcccacctggccagcgggaaggggggccgccgccgcctcccggttttgggcagccctggccagctccctgtggccttggaggacttccaccgggcaggcgttcccatgatgccaggctaccaggcgcgggggattcctgcaggccggcgctgcttttcttagaaccccctttctagaaaagtacacctggaggttttgcttcaaagagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcgtgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaa

SEQ ID NO: 1799 - DNA, 753 bp, Homo sapiens
agcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgtcccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgtgcttgctatctgtctcatgttacagagcttccattacatattaaacgtg

SEQ ID NO: 1800 - DNA, 4050 bp, Homo sapiens
gctggaagccgagaggagaagacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccttctctggtggtgaagagaaatcttgttcaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccaaacctctgctttcaaatgcctcggcaactccagttggcagaaggggccgtctggccaatcttgccgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctgtcctcaagtgctgatgatgcgtctttggttaatgcctcaatttccagctctgtgaaagctacttcttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattccagtacagaacctaaaggtttcactgaatgcgaaatgacgaaatctagccctttgaaaataacattgtttttagaagaggacaaatccttaaaagtaacatcagacccaaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaactgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaata

SEQ ID NO: 1801 - DNA, 1376 bp, Homo sapiens
agaaggcgtgggaggaagatggactcggtggagaagggggccgccacctccgtctccaacccgcgggggcgaccgtcccggggccggccgccgaagctgcagcgcaactctcgcggcggccagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgc

SEQ ID NO: 1802 - DNA, 6409 bp, Homo sapiens
aaagatcttttttttttttttttctttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaagctgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagattggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaggttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattggcccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgtctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaagacaaaaaaaaaaaaaaaaaaaaaa

SEQ ID NO: 1803 - DNA, 6839 bp, Homo sapiens
gccccggcccctcctgcccatggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaatcggaaaatgaacgaaattaccacattttctatcagctttgtgcatctgcacagcagtcggaatttaaacatcttaaattggggagtgccgaagaatttaattatacaagaatgggaggcaatactgtcattgagggtgtgaatgatcgagctgaaatggtagagactcaaaagaccttcacgcttctgggtttcaaggaggattttcagatggacgtttttaaaatcctggcagccatcctacatctgggcaacgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcaggcaagcagcacacttttattggtgttttggacatttatggttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcctcaaaagctgtataataattttgtcaacaggaaccctttgtttgaaaagcctagaatgtcaaacacatcctttgtcatccagcactttgctgataaggtagagtataaatgtgaaggtttcctggagaaaaacagagacaccgtctatgacatgctggttgaaatcctgagagcaagcaagtttcatctctgtgccaacttttttcaagaaaatccaactcctccttctccttttggttcaatgattacagttaaatctgcaaagcaagtcatcaagccaaacagcaagcatttccgaaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggcattctcatgaccaagcaagagctttccttcagcgataaaaaggaggtgtgcaaggtggttttacacagactcatccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgaggaaagctattactgcagtggccttaaaagaagcttgggcagccataatcattcagaagcactgccgtgggtatcttgttcgcagcctgtatcagttgattcgcatggccaccatcacaatgcaggcctacagccgaggattcctggcaaggaggaggtatcgaaagatgctggaggaacataaggctgtgatcctacagaaatacgcacgggcgtggctggccagacgcagattccagagtatccgacgattcgtgcttaatattcagcttacttacagggtccagcgtttgcagaaaaagctggaagatcagaacaaagaaaaccatgggctggtggagaagctgactagcctggctgctcttcgagctggggatgtggaaaagattcagaagctggaagcagaactagaaaaagcagccactcacaggcgaaattacgaggagaaggggaagagatacagggatgctgtggaagagaaattggcaaagcttcagaagcataattcagaactggaaacacagaaagaacaaatacagctgaagcttcaagagaagactgaagagttaaaagaaaaaatggacaacctcaccaagcagctctttgatgatgtacaaaaggaagaacggcaaagaatgcttcttgaaaaaagttttgaactgaaaacacaagactatgagaagcagattcagtctttgaaagaagaaattaaagctctcaaggatgagaagatgcaactccaacacctggtggagggggagcacgtcacttctgatggcttgaaggcggaagtggcccgcctgagcaagcaggtcaagacaatctctgagttcgaaaaagagatagaactacttcaggcacagaagatagatgtggagaaacatgtgcagtcacaaaaacgggaaatgagagaaaagatgtcagagatcaccaaacaacttctcgaaagctatgacattgaagatgtaagaagcaggctctctgtggaagatctggaacatttaaatgaggatggagaactttggtttgcttatgaaggactaaagaaagcaacacgtgttttggagagccatttccagtctcagaaggattgctatgaaaaggagattgaagctttgaacttcaaagtggtgcatctcagtcaagaaatcaaccacctgcagaagttattcagagaagaaaatgacatcaatgaaagcatccgtcatgaagttaccaggctaacatcagagaacatgatgatcccagactttaaacagcaaatttcagaattggagaaacagaagcaagatcttgaaatccgcctgaatgaacaagctgagaaaatgaaaggaaaactagaagaattgtctaatcagttacatcgcagtcaagaggaggaaggaacacaaagaaaggccttggaagcccaaaatgaaatacataccaaagagaaggagaagctgattgataagattcaagaaatgcaggaggccagtgaccacttgaagaaacaatttgaaactgaaagtgaagtcaagtgtaacttccggcaggaagcatcccggctcactttggaaaacagggatcttgaagaagaattagacatgaaagacagagtgattaaaaagctacaagatcaagtcaagacactaagcaagacaattggaaaagccaatgatgtgcactcgtcctcaggacccaaggagtaccttggaatgctgcaatacaagagagaagacgaggccaagctcattcagaacctcattcttgacttgaagccccgtggcgtggtggtgaacatgatccccgggctgccggctcatatcctgttcatgtgtgtgcgctacgcagactctctgaatgatgccaacatgctgaagtccctcatgaacagcaccattaatggcatcaagcaggtggttaaggaacatttagaagactttgaaatgctgtccttttggctttccaacacttgtcattttctcaattgcctgaagcagtacagcggagaagaggaattcatgaagcataatagtccacagcagaataagaattgcttgaacaattttgacctttcagaatacagacagattctcagtgatgtggctatacgaatatatcatcaatttattatcataatggaaaagaatatccaaccgataatagttccgggaatgctggagtatgagagcctgcagggcatttccggcctgaagcccacaggcttccggaagcgctcctctagcatagacgacacggacggctacaccatgacctccgtcctgcaacagctgagctacttttacaccaccatgtgccagaacggcctggaccccgagcttgtgaggcaggcggtgaagcagctcttcttcttgatcggggcggtcacgctgaacagcctcttcctgcgcaaggacatgtgctcctgcagaaaagggatgcagatcaggtgcaatatcagctacttagaagaatggcttaaagataagaacttgcagaacagcttagcaaaggaaactttggagcccctctctcaggcagcctggttgcttcaggtcaagaagaccacagacagtgatgccaaggagatctacgaacgctgcacctcactgtctgctgtgcagatcataaagatccttaattcatacacacctatagatgactttgagaagagagtgactccatcctttgttcgcaaagtacaggctctcctaaatagccgggaggattcatcacagctgatgttggataccaaatatctctttcaagtcacatttccttttaccccctctccacatgctctggaaatgattcagatccccagcagtttcaagctaggctttctgaataggttatagcaggagaaaaagtcaatgcactttttcttcaaaagctaagtgaaggttcaatatgagggatgtgttttattaattggcagtggaaattgggaatgtgatttaaggaagaaaacagacttttgctcaaatggaccacatcatctctcactcacagtgacaatgctgctcctgtaattttgtaagaattcacacacaccagctgtatttggaaaagccatgtctcactctcgaatctcagctggttttcactgaaattcctggagggctcatattttcttccacgtgcctcttgatctgttctgtcttgtggcagggctctaccaggagggagtgagatctggggacacagtggcttccaagttttctaaggttcatgtgaaacctgagtacatttacaaagctgcaagtggattctagtgctgagtcttccaggaaaaaatcccgtttggccaccgtgacctgccaaaagttctcttgccccatgcctgctggggacagaaggttttcatgaactctttttactgaaaatgccctgcatttaaaaatgtttattttagacccttctaaatttttttttttttttgagactccggagtctcgctctatcgccaggctggagtgtagtggcatgatctcggcttattgcaacctccgcttcctgggttcaaacaattctcctgcctcagcctcctgagtagctgggactacaggcacctgccaccacgcccagctaatttttgtatttttagtggagacaggtttcaccatgttggccaggatggcctcgatctcttgacctcgtgatccgcccacctcagcctcccaaagtgctaggattacaggcgtgtgccaccgcgcctggctgacccttttaatttttaagagtgttcaatccgagatgaatcatttgaagtatttttatatgtatatctatttaaaactaatatattattaaagcttaattgccatgccgtttatcttctctgaaagaacttcaaatcttacctgccaacatattcaccataatttttttattttttaatacctttcatacaataacttttttaaaacaacctcagattgaaaaagcaacctaaattactttcgctctctaatcagcatttcaatgtatttatttttaaattttctcaaaaagtaactaaaaaattgtgtcggaccctacttttgagaaatttacgtttcccaagttttatgggaactggctattccttgtcccggcacaccttctcattccttcctttcagagcctaaaacctcatttgataagcactcctagtctctggcctgtggatccagtgctattctgtcaccaacctaagaatcccaattgcaccttctgtttctgacagtcacaggtgacagctgtgattctataatacagactggtgtcttagaggtaggaataatacatgattatgaagcatcaccctgctaatacataataatgtctttttatattataagtgattgagtttagttcatttcaatacattgtacatgaaaaaatgaaaagtagaactttgtaatactttaatcaataaaattaattaccaaaaaaaaaaaaaaaaaa

SEQ ID NO: 1804 - DNA, 1104 bp, Homo sapiens; identical to SEQ ID NO: 153

SEQ ID NO: 1805 - DNA, 2120 bp, Homo sapiens
ctcctctcctggcccttctacgcctcccctgttccttctcctccccgtcccttctcctcttccctgaccctcagagctctggagaccaccccccatcccctgaccagctacacattttacaactagtgcacttaagttggggaggggtctgttgtgcgtcggtggggcccacgtcctcctcacaacttcttggaatcagtgacccgtgctgtcctggctgccgggcttaagccctccgggaccaaagacacaagctcgagtttcctctaagaaaagaaagcgcccaagaatgtgggggtgaaactcccctgtaattaggatcgccagaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggttaggaaagattacgacaccctttctaaatgctcaccaaagatgccccccgctccttcaggcagagcatataccagtcccttgatcgatatgtttaataacccagccacggctgccccgaattcacaaagggtaaataattcaacaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaagccccacaccagtgagaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctttactgtattttttaaatgaattttttccttaataacagccagaataagggatagtctatgctttcaggactggctttctgcacctgatatgaatgagaccagttttattttataaagcatgtgctcttaatagcattatgtctaaagaagatatcacgtaagtttgcatcttagcatgcaaatcataattttaagcaatataaattatgaaaatactatataaatggtaatttaacttaaaatggtttaagtgtagagcttccaggagatgggaggaaacccccaccctcccctcccaacccacggccaggagcctggtaggagtgccttaaggacgcctttgcctggcccctttattacagcccaacacggtaggcacctcggcgggaatctcccttcc

SEQ ID NO: 1806 - DNA, 1188 bp, Homo sapiens
atggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtcactgacagtgcccagggctctggggtgtctctcacagctaataaagtgtgagacagcttccttgtgtgggactgagaagcaagatatcaatgtagcagaattgcacttgtgcctcacgaacatacataaattttaaaaataaagaataaa

SEQ ID NO: 1807 - DNA, 3033 bp, Homo sapiens
gagcgaacatggcagcagaatgaggaggctggcgccgggtcgtggccgccgctgccgcgctgcagctcgggatcccagtccggcgcgctccgggccgcatccttagccggcctcctggcggccgcgggattatttcattcccaacggagagctagggagaaaggagactcccccgcggagcggttccgtgctctggcagggtgtagacgtttgtctgtgcgattcgccggctgcgcaaacgacgcgggagagagccggtcccgggctgcggcggcgcggccgcggggatgagccggccatggagcggccttggcggggcgcacgcagcggactggcgctgccgcgggagcgcagcctgagccggggctccagggggcttcgaagcctccggcgccctgggggggtccctgccgccgactccgggaaggacgcgagccccgcgtggcggacactgccgcagtcaccgttctgaggcgccccgagcttgctccgcctgcagctcggtgcgctctgggcacccgggcgccttgcccggtgcacggcggctggcgcaccgcggctagattggctacaggagcggggtgcaggactggctagaggtgggtgtgtgcgcgcgttggactggagatccgagcagaagcagaaccaggcggctctgagcagccatgcttcccggggtgggcgtgttcggcaccagcctcacggcccgtgtcatcatcccgctgctgaaagacgagggcttcgcggtgaaggcgctgtggggccgcacgcaggaagaagcggaggagctggccaaggagatgagtgtccccttctacactagccgcattgatgaggtgctgctgcatcaggacgtggacttggtgtgcattaacctgccgccgcccctcaccagacagatcgctgtcaaaaccctaggcatcggcaagaacgtcatctgcgaccgcacggccacgccgctggacgctttccgcatgacctcggccgcccactactaccccaagctcatgagcatcatgggcaacgtgctgcgcttcctgccggctttcgtgcgcatgaagcagctgatcgaggagggctacgtgggcgagccgctggtgtgtgaggtgcaggtgcacggcggcagcctgctgggcaagaagtacaactggagctgcgacgacttgatgggcggcggcggcctgcactccgtgggcacctacatcatcgacctgctcaccttcctcaccggccaaaaggccgtcaaggtccacgggctgctcaagaccttcgtgaagcagactgaccacatcaagggcatccgacagatcaccagcgatgacttctgcaccttccagatggtgctggagggcggggtgtgctgcaccgtcaccctcaacttcaacgtgcccggcgagttcaagcaggatgtcactgtggtgggctcagccgggcgcctgctggccgtgggcaccgacctgtacgggcagcgcaacagcgccccggagcaggagctgctggtgcaggacgccacgccggtgagcaactccctgcttccggagaaggccttcagcgacatcccctcgccctacctgcgcggcaccatcaagatgatgcaggcggtgcgccaggccttccaggaccaggacgaccggcgcacgtgggatgggcggcccctcaccatggccgccaccttcgacgactgcctgtatgccttgtgcgtggtggacaccatcaagaggtccagccagacgggcgagtggcagaacattgccatcatgaccgaggagccggagctgagccccgcctacctgatcagcgaggccatgcgccgcagcaggatgtccctctactgttagcacagattgagaacctcggggacttgagccttctgcaggggatgtccacagagagggaagggccgaggggagagggtgaccatggggaatgtggggatcagggaggtggagggacagtgtgaataaatggcatctaggaaggtaaactccaatcccggtgaccgaccccaaaccagactgttggtgggctgagctcctagcctggaagcattcaggagagcctgccattcctgggatgatccctgctgggtatttgcacgagagtggtttggtttagctgcctctgctgccctttactgtgacaagcaaggaggggttgcttccctccctacctcatccatcccacacaccttggccttctgcaagccaagtggttctgcaaggtcaaggcactagtatcagatggcaagctcagtgcccgggattcccactgctggcaggagaaggcccattttcacagtccacagaagcgtgttaggctggggctgggggtgggatgggctggtgagaaagttcaaattccaggaagccactttttattggatataaggtatctaacggcaaaagtacttagtagcaaagtggccaccttttgattgattgggcttcctcataggaagcactgagggtgtgtctttgtacttggttcattgcccttcacctggtagagaaagagaggtcagaaatagcaagcaaaaagcaggactcccaggagccacaagaaaagagcacaggctgcaccaaagcaggggcagcagagaataaaatatccctttgaacttgtcaacaattaaaaaactgcaaggagtcaccttataacactatttccagtaaaggtggaattgagtatcagagggattactgcggtgttaaggtagccctgccacgtggctctccaggcagggccaagaagacagcacaaagtatgggtttggccataagctcatatgctgcccccaaagactggggagagctgtgtgcctcagtgttgcagtgtgaattcctaaatagagggtaaagtgagcctagccaggaggtgtttggggctctatcgcgcatctctcctaccaagctgggcaagagcttttaggagattcatccagctttgtggatttagaaaggaagccttcagttccaatcagaatcctctttcctttaaaaaaaaaaaaaaaaaaaaaaaaaaaaaaaaaaaaaa

SEQ ID NO: 1808 - DNA, 2203 bp, Homo sapiens
ctgatgatcttgaccgacccagtgaggaagttttctctagagatctttcagattttccatctctagaaaatggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcagcaagcactttctcaggctgcccccatcccagaagaggacacagacactgaagaaggtgatgactttgaactacttgaccagtcagagctggatcaaattgagagtgaattgggacttacacaagaccaggaagcagaagcacagcaaaataagaagtcttcaggtttcctttcaaatctgctgggaggccattaatctaggaatcagctcgcaacagagcacaaaaaacaccaaaaaaatttcaaacaagaaaaaaaaaaaaaaaaaggaaaagaaaaaaattgaactgtaagctttaatgattactttagatttgttttattttccctcctgcagtgaattaattggatatatatcagctgacactgatagattgatatttctgatcgttatttttgtgtaataagcatggaaatgaactttatacacaccactgtgttgtcagagataaatattaggggttgtttttaaagcaaaaagaaaaaaacaaaaaccaaactattaaaatcctcctataaatattctttttctttacagtttttcaagcatgcaaaacagtttattgtaacttactgaaaaatattaacaattaattgtgaatacatgctgttaccagcttccttattcctaatacctggaaaatttttttttcaacggatagattttgatgtaaaaaagaccgaaattatcaaggtatcttagttgaaggacttgggaaatactatcaaaattaatttcttaggaaaaaatttaaaagtatatttaagtactctggatagactgaaacgtttccatgttatttctgcagttgtagacttaggcttatttgtaaagaagcatgctccattgactgccatctctagtcttgcagtgggtggtattaacccatagaaagcaagcagttgtgtatcacatagacaatggttatgatgtaaacagattcagttgttttgttgttcattcgtcatatgtttgtgatagggatgttgggagcacagctctattctgcctgctcagacttaagttagacccttatcttttatattatgtcatgaaaaaagtctcctaaaattgtgaaactagttcttgatgagtgatgtgatcatcagcaataaagatataataactctgttttcttagcctgtatagaggagaggaacctgcttggctttaaaatatatttatttgccatttaagtataaatatggaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaaaaaaaaaaaaaaaa

SEQ ID NO: 1809 - DNA, 1483 bp, Homo sapiens
cttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagaaccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcaggaaacaagccctgtctgaccgccaaggcttcatactcaaggatgtctatgcttccccgtgtgcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcatgtgactttcctagataacactgctttctcataataaagactatttgcatttg

SEQ ID NO: 1810 - DNA, 2291 bp, Homo sapiens
ctttctgtgctgatcttggaggcagagtggctgcctgcattcattccacggtccattccacagcttgttccaaagacagtctgctcatgatgtagcttctgcacttgacaaactattttcatgcacgaggcccttgaaaatgttgacagtcttgtgacatccatggagggccttatttgacggtcacaaaggagcggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacagagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgccaaaaaaaaaaaaaaaaaaaaaaaaaaaaaaaaaaaaaaaaaaaaaaaaaaaaaaaaaaaaaaaaaacaaaaaaaaaaaaaaaaagc

SEQ ID NO: 1811 - DNA, 4020 bp, Homo sapiens
gtcaattgccctttagtcccaggactaaccggaagcttctgcaacaggaggacattgaaaataagatggaacccatccacataaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctcggccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcacctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgagcctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctccttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttgaatgacataaaataattgtgcaatgttcctgatgatgtaccccacagctgcattcaaactcaaatctgtgggaatgagtgactcgaccaaatgtaattcggatcagatcctcatcccctgactgtgtgaaaaaagtactctccttctagtgaaggattgtcacagagtttcactggatgaaactatgacccagtattcttactgtattttacatgtgcctgtaaattattttgccgaaataagaagaagaagaggaagaaagaacagtagaaaaaaaaaataaaaaaaaa

SEQ ID NO: 1812 - DNA, 1143 bp, Homo sapiens
atgcggtcccgggttctgtggggcgctgcccggtggctctggccccgccgggccgttggcccagcccgccggcccctgagctccggtagcccgccgctggaggagctgttcacccggggcgggcccttgcggaccttcctcgagcgccaggcggggtctgaagcccatttgaaggtcaggaggcccgagttgctggcggtgatcaaactgctgaacgagaaggagcgggagctgcgggagactgagcacttgctgcacgatgagaatgaagatttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtcaggaggcaatgttgtttacatcagagatatttgatatgtatcagcaatatgctgcatttaaaagatggcattttgaaaccctggaatattttccaagtgaactaggtggccttagacatgcatctgccagcattgggggttcagaagcctataggcacatgaaatttgaaggaggtgttcacagagtacaaagagtgccaaagacagaaaagcaaggccgcgtccatactagcaccatgactgtagcaatattaccccagcctactgagattaatctggtgattaatccgaaagatttgagaattgacactaagcgagccagtggagctggggggcagcatgtaaataccacggacagtgctgtccggatagttcatcttccaacaggtgttgtttctgaatgtcaacaagagagatctcagctgaaaaataaagagctggctatgacaaagttacgtgcaaaactgtacagcatgcatctagaagaagaaataaataaaagacagaatgctagaaaaattcagattggaagtaaaggaagatcagagaaaataagaacatataattttccacagaaccgggtcacagatcacagaataaacaagacgctgcatgatcttgaaacttttatgcaaggagattatctactggatgaacttgtacagtcattgaaggaatacgccgattatgaatctttagtagaaattatttcccaaaaagtttaa

SEQ ID NO: 1813 - DNA, 1606 bp, Homo sapiens
tataatgaagccaagaaaacgctgacagagctgaagacttacagtgagaaactggacaaagagcaagcagccctcgagaagatagaatccaaagctgatccaagtatcctacagaacctgagagcacttgtagccatgaatgaaaatctgaaaagtcaagaacaggaatttaaagcacattgtcgagaggagatgacacgactacagcaagaaattgaaaacctgaaagctgagagagcaccacgtggagatgaaaagaccctctccagtggagagccgcctggtaccttgacctctgcaatgactcatgacgaagacctagacagacggtataatatggagaaagagaaactttacaagatacgtttactacaggctcgaagaaatcgagaaatagcaattttgcaccgcaagattgatgaagtccctagccgtgccgagctaatacagtatcagaagagatttattgaaccctaccgccagatttcagcagtgcacaaagaaaccaagcagttcttcactttatataataccctggatgataaaaaggtttatttggaaaaagagattagtctgctgaactcaattcatgagaacttctcacaggccatggcctcccctgctgcccgggaccagtttttacgtcagatggaacagattgtggaaggaattaagcaaagtagaatgaagatggaaaagaaaaagcaagagaacaaaatgagaagagaccagttgaacgaccagtacttggagctgttagaaaagcagaggctatactttaagactgtgaaagagttcaaggaggagggccgcaagaacgagatgctgctgtccaaggtgaaagcgaaggcctcctgaacatccccagccgtggctgtatgtcattgattttacttttaagcaccgtatatcacctacaagatcatgaaatggttctgaaagcgacagtagagagatgcagttgtgatgatttcaacaacctggatgttttctttctcctctttgcttccattcatctctgttggctgctgttgatggagtcagacagtaaacacgtggcttggataacacccatcatcctatgaagaatatagggagtacttgttctctgttgattcaacttttatgtctccagtaacattgcgcttatgaaggtacctgtatttgtatggactctgaataaagaagaattcatttgtttagcaagtattagttcagcaaccactgagaaataagcactgaggaagattcagagacgtgtaaaacacagttcctactgcacaagtacccagcaggtggcccagggaggcagatacagcacacttgaccgcagaactgggctatccaagatgtttttcagtaaacagaaggcatttagctgaaatgatcagcccatgtagtgttggtcacttgggcctttcacctgccatggtaccttttgttcccagctcctccaggtgccagccagcaggcttggtggtgacagcaactggaacgaaagttcagtgttgttttaatttttatacgttactcaagttgatttctcagaaaattgaaaacagaccttgtgctgaggacacgtcaataaaaattataccttcccctg

SEQ ID NO: 1814 - DNA, 2035 bp, Homo sapiens
attaacctccagctttttaagcagtttatcgatggtcgactggcaaaactaaatgcaggaaggggtttctctgatgtatttgaagaagagatcacttcaggtggcttttgtggagggaacccgaggtcatatcaacaatgggtgcatacagtcaagaaaggaggtgcactgttcaacacagcaatgaccaaagcaacccctgctgtacggacagcatataaatttgcaaaaaatcatgcaaagctgggactaaaggaagtgaagagtaaactaaaacacaaggaaaatgaagaagattatgggacctgttctagttctgtacaatatacaccagtttacaaattacacaatgaaaagggaggaaactcagaaaagcgtaagcttgctcaggcacgcttaaaaaggcctcttaagagccttgatggtgctctatatgatgatgaagatgatgatgacattgaaagagcaagcaagttatcttctgaagatggtgaagaagcttctgcttatctctatgagagtgatgactctgttgaaacaagagtgaagactccttactcaggtgaaatggacttactaggagagattcttgatacattgagcacacacagctcagatcaggggaagctggcagctgcaaagagcttggatttctttagatcaatggatgacattgattacaaacctacgaataaatctaatgctcctagtgagaataacctggctttcctctgtggtggttctggtgaccaagcagagtggaatcttgggcaagacgatagtgccctccatggcaaacacctccctccatctcctaggaagcgggtttcctctagtggtttgacagattctctgtttatcctgagagaggaaaacagtaacaagcacctcggtgctgacaatgtgagtgaccctacttcaggactggatttccaactcacttcccctgaagtttcccagactgataaaggaaaaacagaaaagagggaaacactaagccagatttcagatgatctgcttatacccggtcttgggcggcattcatcgacttttgttccttgggagaaagaagggaaagaagccaaagagacttcagaagatattggactgctccatgaagtagtgtcattatgtcatatgacatctgacttccaacaaagcttgaacatttcagacaaaaacacaaatggaaaccaaacttaaatcttgcatccaagcttctatggagacattttgagattcaatgcaatctgtataataaacagaattatttgtaggaatggcaactcatactatttaaatttttttttgcatttgcaacatttttctcacttgttcatttcgaggatatatgaaatgcattgatttttaaatataaagcgaattctactgtgcttttaaatcaggtactagtttgtatgtatgtttaaagtatgtattgaccatgagatttcccagtgtttggtgcttaatgccgtttattttatttaagctaagaatgcatatgtaacccatgcacataaccagtagctactatactaatctggttgagcatgaactgatcaagatatcaaaacttatcaaaactagcctgaagctgatgaaactgttaacccactaattgccttaatcttaaagctgttttttaagcatacttaaataatgtatgaaagtatgtataaagtttgaaggataagttattagtgttctgcagagcaataatgcctttttctattcatcaaatcaaggtcaaaattcatcttttcaagattaaaaagctctcttaatggaaatatttaatttgcttatataaagcactatagccatgttttccaaaaagtataaaatatacacttacctttcattcagtgaaatataggaagtgctgaattacaatgtgaagttaatgacttctgtttacaaatgagacactctaacgagttttcagtctctctgtatgcctttgctatttaggggtccaccccaagaaagccaaatacaacataaaccgtcctgacaaaaaaaaaaaaaaaaa

SEQ ID NO: 1815 - DNA, 1663 bp, Homo sapiens
atcgagtcggccttgttgggtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaactcgacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacag

SEQ ID NO: 1816 - DNA, 3361 bp, Homo sapiens
ttgctacatatggaactattattattagaaacctttcagtggaacctctgccttccaacagccgcccatttcattgagtattatctctctgaagcagtacacgaaacagatcttcatgacggctggccaatgatttgcttggaaaagactaaactctacatggccaaatatgcagattacttcctggaagtatctttgcaagctgctgcatgtgtggcttcttcgaggattatacttcgtctttctccaacgtggcctacaagactacatcgtcttactgcctactcttgggatttcttagtgcagtgtattgaacgactgttgatcgctcatgataatgatgtgaaagaagcaaacaaacagagagggcaagcaggacctcagtcagcgcaactaagtgtattccagacagcctcccagccatcacggccagttcactttcagcaacctcagtatctccatcagacacatcagacctcactgcagtatcgccatcctacgtcagaacaaccaagctgtcagcagattgtatcgaccacacacacctcatcttacacactacagacatgtcctgctggcttccaaactagtgttcagggccttgggcacatgcagactggtgttgggatgtcactggcaataccagtagaagttaagccctgtctgagtgtttcttacaaccggagttatcagataaatgaacattacccttgtattactccatgttttgaaaggtgattatttgtgaagctgataaccgacccagactgctttgtgacatgaagctatgggtaagcgttttgtaaacttctgttcaaaaggaaagggatctaaatgacatcagaactcttcaggtaccagcaccaggaagactgaatatcctttttaatgcaccatgaatcctgggagactaagcaaattaacagtatgtcaaattctgttacaacaaatccctgtatgacaaaaatgttcaagtcctggctgatggtccaaatttttcaaaaatattcagtacaacagaaaatttggacagacttcaatttgccattttgagatttgacctgtggtagcatctgggcctaatgttggcttctaagtcaaagactaaatgtttatctcatctatggacttgccaaacagtcttttatgaaggaaagttacagtattaatttttgaaaaggttttttttattctgcaattttttatttttgttctacacatgaatttttgactaagtttaaactcatgaattgttatgctataccaatctgcagtaaaaaaaatttttttagatgattctatataacttcgtctcacaaatagtgtaggtatctgggtttatatactaaaattaagggtggagaagatcttattttttaaatcatggtcataatttttctttttttccctaagtgatcaacatcaaatttttagaattaaaatacatttaactcagggaatttgtactacttggaaacacttaactgtaatgcaacatgccttgggaatgttatagtgtgaactacctttataacataggttaaaatacgcttgctagggtgtgttttcaaatgagaacataatatagctcagaatgaagtggtagttcctgtgattcataatacatatgtaggttttgcatatctcagtgcaatccatgatttatactcagaatcgacattcttaaaaagttatttcaagggatggcataactgtaagaggtcagtgctagaataaagtcctgtaggtttattttggaagggactgtggccagggtagttctcaggttgtgctagagcagcactttgttatgtggaagacaggttttttaagcaacctttgaatccagctctagtcagtctaagcaggcaaaggtaactgatgactaaatttcagtagctactttcattggattgaccctacaactgccctgggacatttcactgtaccagtattaactgcaaacagcaataattgtcattacagcaagggcagtttgggggtaaagcattttggaggaataaccttaaaaagttaaaaagtcattgtaataactgataaactgtatacattgtgctcctttctgggggaagaaagatttggtggagggaagctttctggtttaaaaattagtaaggtgtgtctttttgttttttttaagatagcacttgaatagaagggaaaactgcatggcagatacgtgactgccacaatatgcatcgaagacaaacttactataaagatgttgtgggtatgcagcaggagtctcagtaatcaagccaatggcctttgtcaggaagggaaggggctcaacacagtgatggactgatccagatggctcccggggatgaatgtgggtgggtagcttctgtcagtatcaatgcttagagaaatatcctttccttaaaaagaaaataacttttatatttagagtacatagggcatgatgtggatttattagtctggtagataaaatgaaaaaccactcaggtaagaacactcactcatggcagtttttaagcatgaaaattgttttctgaaagtatcatcacttttcctttttaaagaaggctgctaattggattttggtagttcttacctcaagaaaacttgaattatttgggggaaagtaggctcaaaagagaatatatctttcacattcacattcagaacccagcaacctggagtccaattttcagtattttaactacctcaataatgctatgaatgtaagatattgggatagagatcccaacttgaaacaacagccagtgcctgtggtaacttaatgtcttgtcaaatacttttattgattggtttatatgccattcttgttatagaagaatatgccttttaaaaaagcttattaataacactttcccaatttatattttaaaaagctaaagaacactggattaataatcttttgggagggtagaataaaataattgattactattgctgcatacccggggtgggatggggtggttggagaaccagaactatttttaaaacattaggtttcaatataaatacaactcacaactgctagctttggggggtgggggaacattgtttgggttttgttttgtttaatttattgattagtctttaaagtaggcttttttttttttttttgagaatactggaccatcattaaatgtgtactgtgaagagattaatatgtatgaagggctttaccaaagtccactaaataaacactactcaagtacagactgcaaaccaaaatgtatctgtgttacgacattaattgcaaatagcaagtatggtgctaaagtctacaccaatggaattagatgagtgctatgcacttaattttaaaataaaactagttttcagt

SEQ ID NO: 1817 - DNA, 507 bp, Homo sapiens
ggtgcttctgagatgtgggcttgcacacgctgttgctatagtacgtgtgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttt

SEQ ID NO: 1818 - DNA, 1510 bp, Homo sapiens
  Modified_base 125, 127, 139, 227: n = a, t , g or c
gcgagcgccgggaacgagcaccaccagggcttggcagcggacggctttagaagagcctagctgctgcgcgcgtcggagaggctcctgggaaactcccacggcccagggactttcgaaagcagagngnggagccctcgancgcgctagtctgcgagtgagcgctcagcccggcacctgttcctccagcgccgccgccttcccacccctcggacccgcgccgctcgcgcgncgcccgttcctgcgatgaatccggccctaggcaaccagacggacgtggcgggcctgttcctggccaacagcagcgaggcgctggagcgagccgtgcgctgctgcacccaggcgtccgtggtgaccgacgacggcttcgcggagggaggcccggacgagcgtagcctgtacataatgcgcgtggtgcagatcgcggtcatgtgcgtgctctcactcaccgtggtcttcggcatcttcttcctcggctgcaatctgctcatcaagtccgagggcatgatcaacttcctcgtgaaggaccggaggccgtctaaggaggtggaggcggtggtcgtggggccctactgacccgccctctgcccccgcggcaaccgctcccacgcctgcccactttgctagcccggctgtgcccctcactatcagagactgggcgaagcaaacctgtcggagtcaattatttctctcgacttcggcctttcggaaagaagcgaccggtttctccctcgccctctgaaagtcctcatgcctggcagtcggaggagagcgcccagactctgaactcagcagaaagtggcaagaagagggcgattagggcgcagaactttggaagctgctacttacttggaatgcggggagaccgacggtgcgaaggcccttgttctcacccgcaggtgggccaagctctgggggcaggtggagagggcgggcaggggagagacccagcggcactgatcgccttgtgaccggaagagtgacctgttaaaagccacgcagcagactcatggggtctcacaaatccgtgtccgggtgcgctcccactcttctcctgctccccccctgccctggaggggaggggcgataaatacctttgattgtaacgtgccgttttaagaggttttgtgtttgtttgcttgaatacaaatgtttgataagtctttttctgccccagtggcctgtttgcctgcctgaggagttacagttttgtcattgtgggaagaaggggtggggggagggggagcctgcgaatttgaacggggtgagttgtttcttttagtgcatttcccactgggtcttttgggaggcgtctagcgttcctgctggccctgggacaaagacccagaatagaactcgtagctcgtgactgcacggtttacgccacaaaagtgctcttgacatccgtgacaccgttttgactttttgtttttttcttatttaacatttccttaataaatgcaacatttaagcgttaaaaaaaaaaaaaaaaaaaaaaaaaaaaaaaaaaaaa

SEQ ID NO: 1819 - DNA, 2516 bp, Homo sapiens
gagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtgagcctgggggcagcctgcctgctgacagggcgaggattgtggggatcatgggagtgtttgtgagtggggctcctgggtgagacctagcccccacccccacagagctcaagggggtggggggctgaggataggatggctcggggcggggcgggggcagaggaggcctccctgcgctccaacgcattgtcctggctggcctgtgggctcctggcgctgctggccaatgcctggatcatcctcagcatctcggccaagcagcagaagcacaagccactggagctgctgctctgcttcctagcgggcacacacatactcatggcagctgtgcccctcaccacctttgccgtggtgcagctgcgtcgtcaggcttcctccgactatgactggaacgagagtatctgcaaggtcttcgtgtccacctactacaccctggcgctggccacctgcttcacggtcgcctccctctcctaccatcgcatgtggatggtgcgctggcccgtcaactaccgcctcagcaacgccaagaagcaggcactgcatgccgtcatgggcatctggatggtcagcttcatcctctccacactgccctccattggctggcacaacaacggcgagcgctactatgcccgcggctgccagttcatagtctccaagatcggcctcggctttggcgtttgcttcagcctcttgctacttgggggaattgtcatgggtctggtctgtgtggccatcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtcagcgccatcgtctttctctatgactcactcacaggggtgcccatcttggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatgg

SEQ ID NO: 1820 - DNA, 1350 bp, Homo sapiens
agactctctggaaagcctgggagctgaattccggaagatccccacatcgatgaaagcaaagcgaagccaccaagccatcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagaaagcagaggagagagccaagatcatttttgccatagatcaagatgtggaggagaaaacgcgtgccctgatggccttgaagaagaggacaaaagacaagcttttccagtttctgaaactgcggaaatattccatcaaagttcactgaagagaagaggatggataaggacgttatccaagaatggacattcaaagaccaagtgagtttgtgagattctaacagatgcagcattttgctgctaccttacaagcttctcttctgtcaggactccagaggctggaaagggaccgggactggaaagggaccaggactgaacagactggttacaaagactccaaacaatttcatgccctgtgctgttacagaggagaacaaaatgctttcagcaaggatttgaaaactctttcgtccctgcaggaaaggattgatgctgatagaagagcctggacagatgtaatgagaactaaagaaaacagatggctggagatgacatttattcaggggcactttgcaggccctaggacttaaatcgaaagttgactttttttttttttttaccaaatagataggggaagggaggagggagagggaggacagggagagaaaataccatgcataaattgtttactgaatttttatatctgagtgttcaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaagaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagtttctataatttattttactggcaaatgtcatgcaacaataataaattattgtaaactttgtgaaaaaaaaaaaaaaaaaaaaaaa

SEQ ID NO: 1821 - DNA, 1774 bp, Homo sapiens
tgaacccagccggctccatctcagcttctggtttctaagtccatgtgccaaaggctgccaggaaggagacgccttcctgagtcctggatctttcttccttctggaaatctttgactgtgggtagttatttatttctgaataagagcgtccacgcatcatggacctcgcgggactgctgaagtctcagttcctgtgccacctggtcttctgctacgtctttattgcctcagggctaatcatcaacaccattcagctcttcactctcctcctctggcccattaacaagcagctcttccggaagatcaactgcagactgtcctattgcatctcaagccagctggtgatgctgctggagtggtggtcgggcacggaatgcaccatcttcacggacccgcgcgcctacctcaagtatgggaaggaaaatgccatcgtggttctcaaccacaagtttgaaattgactttctgtgtggctggagcctgtccgaacgctttgggctgttagggggctccaaggtcctggccaagaaagagctggcctatgtcccaattatcggctggatgtggtacttcaccgagatggtcttctgttcgcgcaagtgggagcaggatcgcaagacggttgccaccagtttgcagcacctccgggactaccccgagaagtattttttcctgattcactgtgagggcacacggttcacggagaagaagcatgagatcagcatgcaggtggcccgggccaaggggctgcctcgcctcaagcatcacctgttgccacgaaccaagggcttcgccatcaccgtgaggagcttgagaaatgtagtttcagctgtatatgactgtacactcaatttcagaaataatgaaaatccaacactgctgggagtcctaaacggaaagaaataccatgcagatttgtatgttaggaggatcccactggaagacatccctgaagacgatgacgagtgctcggcctggctgcacaagctctaccaggagaaggatgcctttcaggaggagtactacaggacgggcaccttcccagagacgcccatggtgcccccccggcggccctggaccctcgtgaactggctgttttgggcctcgctggtgctctaccctttcttccagttcctggtcagcatgatcaggagcgggtcttccctgacgctggccagcttcatcctcgtcttctttgtggcctccgtgggagttcgatggatgattggtgtgacggaaattgacaagggctctgcctacggcaactctgacagcaagcagaaactgaatgactgactcagggaggtgtcaccatccgaagggaaccttggggaactggtggcctctgcatatcctccttagtgggacacggtgacaaaggctgggtgagcccctgctgggcacggcggaagtcacgacctctccagccagggagtctggtctcaaggccggatggggaggaagatgttttgtaatctttttttccccatgtgctttagtgggctttggttttctttttgtgcgagtgtgtgtgagaatggctgtgtggtgagtgtgaactttgttctgtgatcatagaaagggtattttaggctgcaggggagggcagggctggggaccgaaggggacaagttcccctttcatcctttggtgctgagttttctgtaacccttggttgccagagataaagtgaaaagtgctttaggtgagatgactaaattatgcctccaagaaaaaaaaattaaagtgcttttctgggtcaaaaaaaaaaaaaaa

SEQ ID NO: 1822 - DNA, 1194 bp, Homo sapiens
agcctttaagatttccggggatggaatccgaaatggaaacgcagagcgccagggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcaggacttgtaaagaaaccaaggatgttagtgctctgacaaaagcagctgattttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaaccaaattcaccatagagaatgtgacacggacaaggatagttttggctgatgtgaaagttcacatccttggctccttccaaaatatcaagatggcaagaactgccatttgcaacctaatcttgggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccatctgaacaatttcagtcatttgaagcctccgtcccttcttccattctcagccagaagcataaacagaaaagaaagatttaagaggattcacactcaacaggttttaggataatttaaatatcaaaaattgattgttatacttacacattaggtataatttatcatttatctgaaatcacatgtagcagattgcatagtctgtaatcctctcagagggaaacttcttgtttaaacagctctatatggatttatacttttatatttataaatttataacttcatacaaatttataaacatttctttataaattgtaatttaatagattatctcagaaaaa

SEQ ID NO: 1823 - DNA, 761 bp, Homo sapiens
ctggcggtcccgggtgctgctggttagtgtgctctgagggagggtccgagccagccgctgttttgccggagagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctaaaaaaaaaaaaaaaa

SEQ ID NO: 1824 - DNA, 4700 bp, Homo sapiens
atggccccctcggcctgggccatttgctggctgctagggggcctcctgctccatgggggtagctctggccccagccccggccccagtgtgccccgcctgcggctctcctaccgagacctcctgtctgccaaccgctctgccatctttctgggcccccagggctccctgaacctccaggccatgtacctagatgagtaccgagaccgcctctttctgggtggcctggacgccctctactctctgcggctggaccaggcatggccagatccccgggaggtcctgtggccaccgcagccaggacagagggaggagtgtgttcgaaagggaagagatcctttgacagagtgcgccaacttcgtgcgggtgctacagcctcacaaccggacccacctgctagcctgtggcactggggccttccagcccacctgtgccctcatcacagttggccaccgtggggagcatgtgctccacctggagcctggcagtgtggaaagtggccgggggcggtgccctcacgagcccagccgtccctttgccagcaccttcatagacggggagctgtacacgggtctcactgctgacttcctggggcgagaggccatgatcttccgaagtggaggtcctcggccagctctgcgttccgactctgaccagagtctcttgcacgacccccggtttgtgatggccgcccggatccctgagaactctgaccaggacaatgacaaggtgtacttcttcttctcggagacggtcccctcgcccgatggtggctcgaaccatgtcactgtcagccgcgtgggccgcgtctgcgtgaatgatgctgggggccagcgggtgctggtgaacaaatggagcactttcctcaaggccaggctggtctgctcggtgcccggccctggtggtgccgagacccactttgaccagctagaggatgtgttcctgctgtggcccaaggccgggaagagcctcgaggtgtacgcgctgttcagcaccgtcagtgccgtgttccagggcttcgccgtctgtgtgtaccacatggcagacatctgggaggttttcaacgggccctttgcccaccgagatgggcctcagcaccagtgggggccctatgggggcaaggtgcccttccctcgccctggcgtgtgccccagcaagatgaccgcacagccaggacggccttttggcagcaccaaggactacccagatgaggtgctgcagtttgcccgagcccaccccctcatgttctggcctgtgcggcctcgacatggccgccctgtccttgtcaagacccacctggcccagcagctacaccagatcgtggtggaccgcgtggaggcagaggatgggacctacgatgtcattttcctggggactgactcagggtctgtgctcaaagtcatcgctctccaggcagggggctcagctgaacctgaggaagtggttctggaggagctccaggtgtttaaggtgccaacacctatcaccgaaatggagatctctgtcaaaaggcaaatgctatacgtgggctctcggctgggtgtggcccagctgcggctgcaccaatgtgagacttacggcactgcctgtgcagagtgctgcctggcccgggacccatactgtgcctgggatggtgcctcctgtacccactaccgccccagccttggcaagcgccggttccgccggcaggacatccggcacggcaaccctgccctgcagtgcctgggccagagccaggaagaagaggcagtgggacttgtggcagccaccatggtctacggcacggagcacaatagcaccttcctggagtgcctgcccaagtctccccaggctgctgtgcgctggctcttgcagaggccaggggatgaggggcctgaccaggtgaagacggacgagcgagtcttgcacacggagcgggggctgctgttccgcaggcttagccgtttcgatgcgggcacctacacctgcaccactctggagcatggcttctcccagactgtggtccgcctggctctggtggtgattgtggcctcacagctggacaacctgttccctccggagccaaagccagaggagcccccagcccggggaggcctggcttccaccccacccaaggcctggtacaaggacatcctgcagctcattggcttcgccaacctgccccgggtggatgagtactgtgagcgcgtgtggtgcaggggcaccacggaatgctcaggctgcttccggagccggagccggggcaagcaggccaggggcaagagctgggcagggctggagctaggcaagaagatgaagagccgggtgcatgccgagcacaatcggacgccccgggaggtggaggccacgtagaagggggcagaggaggggtggtcaggatgggctggggggcccactagcagcccccagcatctcccacccacccagctagggcagaggggtcaggatgtctgtttgcctcttagagacaggtgtctctgcccccacaccgctactggggtctaatggaggggctgggttcttgaagcctgttccctgcccttctctgtgctcttagacccagctggagccagcaccctctggctgctggcagccccaagggatctgccatttgttctcagagatggcctggcttccgcaacacatttccgggtgtgcccagaggcaagagggttgggtggttctttcccagcctacagaacaatggccattctgagtgaccctcagagtgggtgtgtgggtgcgtctagggggtatcccggtagggggcctgcagggagccagagggtggaaatggcctctaagctagcaccccgtaagaagagcctacctgaccgacttggggagggaacacagaggtgttgggaaggtggagcaacaatgcacctcccctcctgtcgcgccgtgatatcttggtggctccctgccactgcccaccgcctcttctccatctgagaatcacggagaggtgtagataatctagaggcatagactgctagagcccccagggatctggggtggtcagggctcaggcttcactttgtaaaccaggtgggggcatctcacagcctgacttcccttccccaggccagggttgctgggatgcctgcccctcctgagaggaccccctccccattgtcaggctctccatgtccacgagcggggaggggtgggttctggggcattgttgtcccttgtgtctgtggactagagatagggtgggggagctggggaagggtgcaggcgggaagagtgggctgtctttcccagggtgatgcaagcatgccgcagccctggaggctgggaatgtggaggctctgtgagccctgcagccctcagaatcagggccagggatgcagaagattgagaggatatggagatggatagagggcaggagacccttaggatagattgtgggacccaggcaggaacaggtgtccacaagaactcaggatggcatcagttagctcagaagccacctggaagacccagtgtttccatctctggaatctctgttttatgctaaatggatttaggaagactgtttttcttttaagggggaaacaaggtagagaaaaggacgaagaagtgtaagtcccgctgattctcgggggtaaggctcggatggcaaggacgcgttctgcctgggcatgtaggggaggtgtttttgccatcaccagtttctcaggctggggagcacagaggggaggaggaggactaaatgaaaagttgttcccagcctgcacatgaacacattcatgacacacaaaactggctggaaggagataagagcactgggtttgagattccctccattaaaacaaccaagacaaagaaaggaggggaaaaaaagataaaaagcaagccagggttccctgccctattgaaactcaaacccagactgccttgggttttatctttcccttacccctggcacctccagagaactgggacctgaaatagtccctccgttctcccctttgaccatgtaataaatgaaccagaagcactgagattaacctatcaacgccctgagaagccttccagcctgcggtgctgtctgctgggaggtcagctggtcaaggcagaggaggagaggaggaaaggatgggggctgaagagcagaagggaggggagacagaggggattaaagaggggaggagagagtgcagagctccaggaaagggtatcagagctgcagccagctctgccctctaccctagggaggccagaaagacacaaacagccctccgggcctttacgctggactctggcttggcaggctccaggcagggtcctctgggaagttactctagaaaacgaagggaggaggagcacaagatcctcagcaacgaacacctgcacttagaaaaagtggacagcttctgccaaccacaccctacccatggtactgtatgctattaactcctggaaacgccccgtaaatgcgagttgtttttgtatttgtgtgttgagatgggccttgtggtttctctgtactcagagcacatttcttgtaattactattgttatttttattgtcatgactgcccctgagctctggtgagaaaagctgaatttacaaggaaagggatgaagttaatatttgcatcacataattatatcattactgtgtatctgtgtattgtactaaatggactgatgctgcgcacatgagctgaaaatgaagagccctcccatcc

SEQ ID NO: 1825 - DNA, 2528 bp, Homo sapiens
cccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctttcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagcc

SEQ ID NO: 1826 - DNA, 1049 bp, Homo sapiens
gggaaggagctgaggaagaagactgactgaaggagcttgcgacttttccgcctcggcaaccggacccagcagcaagcaggacgggcggcgctctgctactggtcccgttaagccagagtagcccaagccctgaagtcactgctcatccggaatggaaatcccgccgaccaactacccagcctccagggcggccttggtggcacagaactacatcaactaccagcaggggaccccgcacagggtgtttgaggtgcagaaggtcaaacaagccagcatggaggatattccaggaagaggacataagtatcaccttaaatttgctgttgaagaaattatacaaaaacaagttaaggtgaactgcacagctgaagtactttacccttcaacgggacaagaaactgcaccagaagtcaacttcacatttgaaggagaaactggaaagaatccagatgaagaagacaacacattttatcaaagacttaagtccatgaaggaaccgctagaagcacaaaatattccagacaattttggaaatgtatctccagaaatgacgctcgttctacatttagcctgggttgcctgtggttatataatatggcaaaattctactgaagacacatggtataaaatggtaaaaattcaaactgtcaagcaagtgcaaagaaatgatgactttattgaattagactacaccattctacttcataatatagcatctcaggagattattccctggcaaatgcaagttctctggcatccacaatacggcactaaagtaaaacataatagccgtctgccaaaggaagtacaactggaataaacaaaaaccctaacactggaagtgcaaacatgtctattgatgtgtatgccaatttcactggcatctagcttatgaggccaaataatcccaaagtgtcactttatataaatgtcttgattacagtatagaactttatagagtccataatacaaagtatcactacataaaaatgtctttaaaacagtaatagtggtatgtatatccaaaataaaaagcttcaatttcagcc

SEQ ID NO: 1827 - DNA, 953 bp, Homo sapiens
agcggcgcaagcggcggcggccactgccacgtattcccggcagtggtggcgggggcggcggcggcgcccgcgggcaggaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccacgctggccgtggtcgtgctcttgatcgtggtgtttgtgtacgtggccacgcgccccaccatcaccgagtgagccccgcagccggctgcggaccccatcggcagggagaggaaggcgcgggagggggacgcaaacaaaaaaatggctttcatattcagagatgttcatgttgctgagctgtaagcaggagcaccctgtcttctctggtctttgacttgattaaagtatctccgctttcttgggagggaataggggatgttttatcagtgaatgtgccatacaccttatggtccacttcatgtgcctttcagacttcaaagcgcgcgcgcatgtgtgtgtgtgtgtgtgtgtgtgtgtgtgtgtgtgtgtgcttctttttctctcctaaaaatcgataagtagctccacctgaagagggatggaacctctgggtcaggaaacagctggaatccacactcacctcattcccattgtttggatcatgcttctttccaacacgtgttcacaatctccaaagggactgtatttcttctctgtgcttaatgtgatttgaaatatgttgaatcaaagtgaaatatttattttttgaataaaggagataatagccttaaaaaa

SEQ ID NO: 1828 - DNA, 4561 bp, Homo sapiens
catgaggctggcgagctgcaacaagtcgtgtgggacgaacccggatggcatcatcttcgtgtccgagggcagcaccgtgaacctgaggctgtacggctacagcctgggcaacatctccagcaatctgatctccttcaccgaggtggacgatgccgagaccctccacaagtccaccagcttgcctcgagctcaccaaggacctggtcgtccagcagcttggtcaacgtgagccgcgggaacacgtccggcgtgctggtggtgctcaccaagttcctccggaggagcgagagcatgaagctgtatgcactgtgcacccgggcccagcccgacgggccctggctgaagtggacggacaaggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacatcatccttctcaccaaattctttatgctactcaccttccccctcagttttcccattagcaagctcctggacttttttctgggccaggagattcgcactgtttacaaccgggagaagctgatggagatgttgaaggtgacggagccctataatgacctcgtgaaagaggagctcaatatgatccagggtgccctggaactacggaccaaaactgtagaggatatcatgacccagctccaggactgcttcatgatccgcagcgatgccatcctggacttcaacaccatgtcggagataatggaaagcggctatactcgcatcccggtgttcgaagacgagcagtccaatattgtagatattctctacgtcaaagacttggcctttgtggaccccgatgactgcacccccctcaagactatcactcgcttctataaccacccggtgcactttgtcttccatgacaccaagttggatgccatgctggaggagttcaagaaggggaagtcccacctggccatcgtgcagaaggtaaacaacgagggtgagggtgaccccttctacgaggtcctgggcctggtcaccctggaggacgtgatcgaggagatcatcaagtcggagatcctggacgagtccgacatgtacactgacaaccgaagccggaagcgggtgtctgagaagaacaagcgtgacttctctgccttcaaggatgcggacaatgagctcaaagtgaaaatctccccgcagctcctcctggccgctcatcgcttcctagccacagaggtctctcagtttagcccctccctgatatcagagaagatcctgctgcggctactcaagtacccagatgtcattcaggaactcaagtttgacgagcacaataagtactacgcccgccattacctgtacacccgaaataagccggccgactacttcatcctcatcctgcaggggaaggtggaggtggaggcagggaaggagaacatgaagtttgagacgggcgccttctcctactatgggactatggccctgacctcggtcccctccgaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaagatcactcggcagcagtaccagaacgggctgctggcttctcgcatggagaacagccctcagtttcccatagacgggtgcaccacccacatggagaacttggccgagaagtctgagctgcctgtggtggacgagaccacaactcttctcaacgagcgtaactccttgctgcacaaagcctcccacgagaatgccatctgacaggagggcccggggccccctgcccaccctgcgggggcctccccagtgggcccacatgaagagagggaacctgttagtccagaaaggatacggatagatagcctgtctgactgaacagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttatttaaaaaaaaaatatttttttcctaaaaactataaaagaggaagggtttcttgtcccgggaagcaacggacataatctgttcccagccatggccttccagcttgtgtccctgattcagggagctctcccttcctcctcctcctcctcctccggaggtgggatcccagagcctgccagtggaggcttatctgttgggaggaagacagctcttcacagaagcaaagaacaaaatggcatggagatcagctgcctgagcacctgcgctgtagcttatctgacaacgctgaggccacgagctcctgggtagctgtgatcagggacatgataatctgagctatgcagaggagcacatctgttgtcaactgctgtacccagaaatctagaactctgccgacagcctctcctggtgagtcgggactcagctgaggacacatccccaccctgcctcccatctggccctttggacaactggccctttgtgacagggctgactcaagtgttaggcagggtctcaggcctttgattgctcacccctgctccccaggccctgccctcacttttaccaaaggttctccctcggcgggagggcatctgtgttggaggtgatttgtctgggttcttccttttggttccagaaggaactgtcagtcatcagcatctgcgttgttagcagtcagtaccacccccgccccacaatgacagtcaaggctgacttgttgactgaagcctttttcccagaccccttatttcgaatccccaagcttcagtccctcttgggggtggagacaagaggacatgtgggaagccacggaagcaggttctttatgtcctctcctctgtggctggcaaggctcacctggccttatccacccacttatggaacctcaggagaggagggctcctcctaaaggcatgcagcttgcagcccctctttctcacacgtgtgatcctagcgtgagaggtcatcctgcccttgctgaagttagtagtactgtactaagagctctgccctcatgtgaattcctgccctggtgcctcttccctggggctgaatcaggccctgctgcaaaactccaggcttcccagggttggggaggctgtgggaccaaggtccatgttggtccttccactgggtgcagcaggagctgggtcccgagagcctggcaggtgaaactctgcaggccttccgcctgattattatttattcactcctttcctcaccccaagtgccctgctctccaggtgcctagagtatcctaactcttaggaccagggattgtcttgcaccaagtatgcctacccctggccagtctgaggtctcctagccatagaactgactcctggaagcctggagagaaggtggtgacacccatgggttctcaactgtaaggaaaaaagacaccagacttttgttccctagtgggggaaagcccttagtcttgtacaggagcagcttgctcccaagtccttttggaagctggcagagctatattcctgacagccctgactgccaggtagagcaaaagacattggtgggggtatgtgaagcaaaaggggcaggtgcacacacctccacagtgacctctgtgcacacggttaccaccaactggctggccctcctcctcttccctggcccattgatcatcccttctcacagagggtcatcattatttccaaatattgtttgtctgatgacttcctcttcccagtgcaatttttcccttcctatttcaacctctggttcctgggatgagccataccctggaactggcccacccactgtgtcttccacgtaagggagacctttgcaaagggcatccaaatgggtaggcaggtgacagccgccgtatttattttgcataatattttaatttgtatatttttgtgatttattttggcgttatgagtttgactctcggggagttttgttgttatgactcttgtgtcttttgtcacaaaacaatgatatttgctaaacgatatatggaatttatttttgattggtaataaaaaatcaaatatgtataaaaaaaaaaaaaaaaaaaa

SEQ ID NO: 1829 - DNA, 957 bp, Homo sapiens
gcgcgtcggcgtggggcgctatgccggggcggcacgtttctcgagtccgggcattgtacaagcgcgtcttgcagctgcaccgtgttctgcccccggacctcaaatccctgggcgaccagtacgtgaaagacgaatttaggagacataagaccgttggttctgacgaggcacagcgtttcttgcaagaatgggaggtgtatgcaacagcgttattgcaacaggctaacgaaaacagacaaaattcaactggaaaagcatgttttggcaccttcctcccagaagaaaaacttaatgactttcgtgatgaacaaattggacagttgcaggagctgatgcaagaagccacaaaacccaataggcaatttagtatttctgagtctatgaaaccaaaattttagtctatacaacaaagcttaataagacatgcaaaaatttagaacccctactttaactgtcattggtttttgaaatatatttaagctttgaaaacacctgttattaatgaaatactcttttattttggatattatgattgcagtatatggatcaagatcactagtgacaattgaaaaaaactattggaataatagcacttgtataaaattcagttttggaactaaacagcaaatttctagaattttgctgaaaatgttttaaaatgctattctcatccagccatattagtcttctggcttttctttagcttcatcaaataagcatgttgtgataatgatagatgtacaattccaacaaggttattattttttaaatacattgtcattctgaacattttatcacttctagtttaataatacatacatgatttttcttctgaatgtctcttctccctgcatcactgttcattcacaatgaaaggttaggaagaagctttaaaattcactattttactatcaatcatttgtataataaactatacaaagtataaaaaaaaaaaaa

SEQ ID NO: 1830 - DNA, 716 bp, Homo sapiens
acggtggagcggtggagggcgtcactgggtttcggcgtctggcaagcggttcagctgtctgctccctagcagccggccttcgggtcgggcgtctccgcggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataaaaaaaaaaaa

SEQ ID NO: 1831 - DNA, 676 bp, Homo sapiens
aatttgccttcgagccaagattcggcacgaggactttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaaaaaaaaaaaaaaaaaaaaa

SEQ ID NO: 1832 - DNA, 1694 bp, Homo sapiens
gcggccgcgccccgccgccaccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccaggaaagaaggattgtccaaatgtggaagatgcaagcaggcattttactgcaatgtggagtgtcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcgaattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagagttttaaaaatggaattattttttctttcatgcctcttgtaatgttctgaacaaacttgaatgatgaaagtattaaagagatatcagtaaaaaaaaaaaaaaaaaaaaaaaaaaaa

SEQ ID NO: 1833 - DNA, 2371 bp, Homo sapiens
atccgcagccaactgtgtggcggtccccactttcgcctagcggcaactccctccctccctgcaatccttccttcttattccggtttccagagcacgtctccaggcttcgacgtcaccacgctgggacgtatgtgccgagggccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaaggatcccaaacttgtaactaaattctgacatatctgttactgctgactcacattcattctccgccattcaaatactattttttatccacattttttttttgttccccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctaaaaaaaaaaaaaaaaaa

SEQ ID NO: 1834 - DNA, 3477 bp, Homo sapiens
cttactgctttgtgaggttgtgagtggccaccactgaaggtctttgagaagaggccagacgctgctgtagccaggcctgtcttaagaggacttgtgcttccagggacccaggcaggatgatggcgcagctcttcctactccaagccaacgctgtccttcccctttcccatgaaatcaaggtcaagaggcaaataagactccctgctccactctaccccccagagagaaatgattctcgctcctttcagatcccccaggatctgagggagaaaggatgggaggaggggcagcagcatttcgctggaaaggcagcagatgcttttccagccccggttcagctggaaggcttggaggccggccagaccactctggcgtctcctgaagtgggtccctggagaccgaagaggctcagtggagtctgtctgttgtcagcactgctgcctgatccctgcaagacaaatggcactttccttcttcagaagcatcatctgccttcattattagcagtaatattattcccagttattattcttaccggtgccagttttgcacatctttttgttgctctatttgtgtctcatttacttctcaaattgcccctgggggcaggaatgaggatgcagagagatgcacgttaattactgtcgcatttttctgtggagaaaactgaggccagggctgaacgctcacagctaaggagctgtgattcagacccagttctgtcagctctagaggcaccctgcatcatgcccaccagggtgatccccctgggatggaccatctcgggatatgaggcctcggaggctggggttgagatttggtcctgaagagcttatagccagattgccacattcaagtgtaagtccaggaaaggggcaggcggcagtgcacagggatttatcagttccagaacctcacagtgataagaggctttagagagcatctaatcgagacctttaatttttcggggagagcagctgaggccgtgtggaaaattagtggagagctgacaagtgtctgggctcctggcccaggggtccgtggtccagcacgttgtgcgttcagtgggaagcaaagggcttgcccgggattacctgccccagccccgaggtgggttgtgctccctgcagctgccatcggcccgctttgcttcgtcctggcagatgcccagtgattgtccccgagcaagtgccagggttgggctgagctgctatgacagggaggcccagggagttctgctcagggagccaaagggaacagccagatcctgaatgttctatgttcacctgccccagccccacccaccctggcccactccacaggcccctgaccatggtcactcacggagagggatggaggagaaggtggttgaactgagtactgagaacccagaggacagagcccacagcttccaagcaggaaaagggacctctctgaaaaatctggataaccagaattatcacagcaccttctcattcccagcgcgtccttctgagctcagaccttgagcatttactgggtttctttttgaggaagagggaaagtgacaaaggacaaaacaatgcaaatcttcatgactgaagacgatcaaagactccctggagcgagaaaacagttactgccagaagcagaatggaagagccaaaaagtacacaaaatggacgccataaattctgaaataaaagtgtatgatgtgttctgagtcactgtagaagtcatgcatttattatcaagatagaaaagagcagagaatgacgtggacattggtcctcggagaggctgcataggtggtgcggtccccggggattctggatgctggtcttttgaccgtggcggcagcctcgcgcctgcccggatggctccatccagacatttggcaaggctgtcatctgctcttgggtccctttttcaagctgatttcctgcctccccaagaggaggtttgagccccattctgccttggaaataaatcctgacagatgtgcacagcatatttgcagggaatttgcaggcctcgattattgggggaatcagagcccattccacaccgagccccatccacgtggctgagcaacacccctgtgtcccctgtatctgtctcactggctgtctttctgccagtttcttaaagaaccacaccattactgcgtttgccgttcgaagcgttgtcccaacaatgcagatggttctgacaagggctctatatgctggcagaagggagcttccaaccttttaacttgaggaaaatgaatctctgagaggcttgagagtgttgccaggtggagcttttcaggagacaggggtcttgagcccaggacaactaactatcgagttttcactaggagacttagtggtggctttcatgaggccagtcgttctcaaggaagggctgggggccatcagcaatgtctggagacatttttgattctcacagcttggtggggactgctattggtatctcatgggtggaggccagggatgccaccgaacatcctacaatgcacagggcagccccccacaaataagaattatccagccccaaaatgccaatagtgccgaggtcaggggaccctgtgctggccatcctatctctgattctgaaactatgcatgctttccacttttccccatttgtgagtcattgagtaaattaaagctcttctgagcagcagcagtgatcatggtcactgccctgagttcaaataatgcgagctgaggacagtgatctgcaactcccagcatgtcatgtggtctcttagaaatccatgtgactgtttccaccatcttgggcatttgtggggacccccagactggagggagaaagccctacaaagtggatgggagtgtggggctgaacttttccctacccttaactttgtgtctctgggacctccagggacctggcccctcaccaatgcatatgaagagtatgcttggggaagagcttaggaatggggtgggcatgggactgctgggtagcagcctttgagcaaatctgcatcttctcttatttctgacctttttccacgtgcccagtcctatttctgccagttgaaggcatactaatattctttatactatttaatcttttgcagaaaccttactattataacttgctactctccagataccaattcttcatgccgagagcatcggaaatgtttttgtgtcttactgatgttttcatgatcaacttgtaaatgtaagcagttgacttcataaaaggtattttaactattcttggagtcctttgctacccaagcacctggtttcaccatgcgatcactgacttctctacagtgaagactctttcttaatataggatttcgctgtgctcttttgattaaaaatatctaaccttaaaagacgtaaaaatgtatctgtgaaatctcactttgttagcgttgctgctgttgtcattttctattatgataactgaaaagagaaaagaagaaaacatgaaaaaaaaaaaaaaaaaa

SEQ ID NO: 1835 - DNA, 1536 bp, Homo sapiens
cggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggcaccatactggacataccttttatgtgcactgggactttttatttaccagtcactggatgctattgatgggaaacaagccagaagaacaaactcttgttcccctttaggggagctctttgaccatggctgtgactctctttccacagtatttatggcagtgggagcttcaattgccgctcgcttaggaacttatcctgactggtttttttcctgctcttttattgggatgtttgtgttttattgcgctcattggcagacttatgtttcaggcatgttgagatttggaaaagtggatgtaactgaaattcagatagctttagtgattgtctttgtgttgtctgcatttggaggagcaacaatgtgggactatacgattcctattctagaaataaaattgaagatccttccagttcttggatttctaggtggagtaatattttcctgttcaaattatttccatgttatcctccatggtggtgttggcaagaatggatccactatagcaggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtagctcacatgaccaaaagtgaactatatcttcaagacactgtctttttggggccaggtcttttgtttttagaccagtactttaataattttatagacgaatatgttgttctatggatggcaatggtgatttcttcatttgatatggtgatatactttagtgctttgtgcctgcaaatttcaagacaccttcatctaaatatattcaagactgcatgtcatcaagcacctgaacaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttaaaaaaaaaaaaaaaaaaaaaaa

SEQ ID NO: 1836 - DNA, 3384 bp, Homo sapiens
gcttctaaacaacctaccctccttccccattttctgtggtccaactaccctcggcgatcccaggcttggcggggcaccgcctggcctctcccgttcctttaggctgccgccgctgcctgccgccatggcagagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaaggaattagaaaagaaatttcagcaaacagcagcttatcgaaacatgaaagagattcttaccaagaagaatgaccaaatcaaagatctgaggaaaagactggcacaatatgaacctgaagattaaaactgaagatttcctctggaagctaccacatgcaaacatacaagcagtctcacctcaggcatgtattttgaaaagcattttgtcatatcccctctccttatttttctaatatttagactttgaatatttagaactagagttcctattttcagctagttgaaaacagagaaaacctagtgattctgtctggtcatcccacacacctctctactgagtgctccagagtcttagctcacatgcactgagaattctttacagcaaagaagagatttttagagtgggaagaagaggcttatccttctgcattagtataaagagtctgtatttttaataaatgttaaataagctaacaatgtttgtacttatgcattccccatgggtaaaaataaataatagcattgttaaagatagttattaccaaaaaaagagagttattacaaataaatatgtctctttatttttaaaaatgaaatcttaattcatttactctatttgatgataaactataaattcattgaaaatgtgaattctattatgggtagcctttttaccaattataaggaaaatttacagcagtgaacatgaacattcacttagcttcctcagtctctccatcttaaagatcatttatcagaggaggttcagcattttttgcagcataacttttcatgagtctgtattactaatggataagtcaaatccatcctgcacttctacagtttagaaagtatctggactcagaataaatgtaatatttatacttgtttccagaatgttattttacattttatgttcaataagaacactttttaaaagacgtatattcaacataaaatcagctatcagacttcagattagactttatttatgtgggtctataataattgtattttcaagaggttttcactatatttgtattggcctggttttctcagacgattttggacaaatcattagaaactgggcatcatatccacagttatgtaaggcagtgatatactataaggataaacaaagtcaagtccataaagcaataatccctcagaaggaaagtccttacttttcacatattaatatttagtaatttttcctgcttctaaaagtgagagtatcacaccctaaatgaacactgtctactaagagacatcattccatttccacaaatgaagattttattccaagaaacgagtttactgattggagcatagggcttgttgttatttttattcaagcttttagtaatagccttgaatttattatttttcttataggctttttgttaaaatagtgaaggaacaaatgttaaagggtaagataatttccctgcaaaaggacacagaaggcagtcttaagaagatgaatggatgagagaagggagagaataaaatgcaataacgagccagcatttactatgtattttctcctcacctgtctctccatatttaggtcacttaccagtttctgtgcccttttggagcttttgttgagggcttcattctcaccctgtatttctttagccctaaattgacactctctccaaaaatccattccattgtctgtggaccaagatgttctatgtaattcagaagcagaactcttggctaaagggctagtgtggccttcagaaaccattcaattattttctccctacacctttgtcagtttgaaaccagtgaggaaaaaaggtatgttgataagaaacctatattgctaggtagaatttgtacttgttttcttggtagcagttttgaaatattctgtacagtacgttcctattgtttaataataaattcaaaaatatttctaaaaccttaaaaccaactatgccaagcattaagataaacaaatatgatgttctttgacgtaaatcaacgtgatgattctttcacatgtaaacacattttagtgtttctggtttgtcatttttgttgttgttgttgttgttgttatttactctataccctttagcaaaatacagttttaaatttttattgtttttagtagtttcccaactttaagacttatctaatttaactgagaaagaaagcctttttcatatatatatatattggatttctaaggatggtggtttgagccttgattagacttttgatgtgctaagccagacaggcagtctgtacattgatggccatcacaatgcagctttggtttaatttaattcaggcctgctgctgagttatgcacagactttttgttgaccaaaataaaatataaagggttttcttctgtttgacatttgtgttcattttttctctttatgtattacattttaacctatattaaataaatgtttaaatgataatttgcttatgtcttataaaactcagcataagaaaaat

SEQ ID NO: 1837 - DNA, 1602 bp, Homo sapiens
ggagatcgctgggagcggttgcgcgtgcggggagctgagttatagctgtgacttctgccctgccaggccgcacacagcggtctgacccggtttggtttgtaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggaagcaatatccaaggcagtgtcatctgcaacaatgctgtgatcgagaagggtgcagacatcaaggactgcttgattggaagtggccagaggattgaagccaaagctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaaggtaaaaaaaaaaaaaaaaaaaaaaaaaaaaaaa

SEQ ID NO: 1838 - DNA, 867 bp, Homo sapiens
cgtttcagcgtggcggcgctggtgctggcgttggccctggaggacggccccgagtgatggctggcgcctgcctcccgggtgtctcccgggtacagatggagtcgtcccgcggccgccggcggcaaggtcggcagctgcgaggccaagagagaccccaggacacacacagctgcctcccggtgcgagaagaagaccccggcttgagagtgagatggcgtttaatgattgcttcagtttgaactaccctggcaacccctgcccaggggacttgatcgaagtgttccgtcctggctatcagcactgggccctgtacttgggtgatggttacgttatcaacatagcacctgtagatggcattcctgcgtcctttacaagcgccaagtctgtattcagcagtaaggccctggtgaaaatgcagctcttgaaggatgttgtgggaaatgacacatacagaataaacaataaatacgatgaaacgtacccccctctccctgtggaagaaatcataaagcggtcagagtttgtaattggacaggaggtggcctataacttacttgtcaacaactgtgaacattttgtgacattgcttcgctatggagaaggagtttcagagcaggccaaccgagcgataagtaccgttgagtttgtgacagctgctgttggtgtcttctcattcctgggcttgtttccaaaaggacaaagagcaaaatactattaacaatttaccaaagagatattgatattgaaggaatttgggaggaggaaaagaaacctggggtgaatacttattttcagtgcatcattactgttccagattcctatgatggatggcagactctttaataaattgcttactgatattatctt

SEQ ID NO: 1839 - DNA, 2110 bp, Homo sapiens
ggcacgaggcggggccgagcgccgcgcgtcccgagcatggcaggctccctgcctccctgcgtggtggactgtggcaccgggtataccaagcttggctacgcaggcaacactgagccccagttcattattccttcatgtattgccatcagagagtcagcaaaggtagttgaccaagctcaaaggagagtgttgaggggagttgatgaccttgactttttcataggagatgaagccatcgataaacctacatatgctacaaagtggccgatacgacatggaatcattgaagactgggatcttatggaaaggttcatggagcaagtggtttttaaatatcttcgagctgaacctgaggaccattattttttaatgacagaacctccactcaatacaccagaaaacagagagtatcttgcagaaattatgtttgaatcatttaacgtaccaggactctacattgcagttcaggcagtgctggccttggcggcatcttggacatctcgacaagtgggtgaacgtacgttaacggggatagtcattgacagcggagatggagtcacccatgttatcccagtggcagaaggttatgtaattggaagctgcatcaaacacatcccgattgcaggtagagatattacgtatttcattcaacagctgctaagggagagggaggtgggaatccctcctgagcagtcactggagaccgcaaaagccattaaggagaaatactgttacatttgccccgatatagtcaaggaatttgccaagtatgatgtggatccccggaagtggatcaaacagtacacgggtatcaatgcgatcaaccagaagaagtttgttatagacgttggttacgaaagattcctgggacctgaaatattctttcacccggagtttgccaacccagactttatggagtccatctcagatgttgttgatgaagtaatacagaactgccccatcgatgtgcggcgcccgctgtataagaatgtcgtactctcaggaggctccaccatgttcagggatttcggacgccgactgcagagggatttgaagagagtggtggatgctaggctgaggctcagcgaggagctcagcggcgggaggatcaagccgaagcctgtggaggtccaggtggtcacgcatcacatgcagcgctacgccgtgtggttcggaggctccatgctggcctcgactcccgagttctttcaggtctgccacaccaagaaggactatgaagagtacgggcccagcatctgccgccacaaccccgtctttggagtcatgtcctagtgtctgcctgaacgcgtcgttcgatggtgtcacgttggggaacaagtgtccttcagaacccagagaaggccgccgttctgtaaatagcgacgtcggtgttgctgcccagcagcgtgcttgcattgccggtgcatgaggcgcggcgcgggcccttcagtaaaagccatttatccgtgtgccgaccgctgtctgccagcctcctccttctcccgccctcctcacctcgctctccctcctcctcctcctccgagctgctagctgacaaatacaattctgaaggaatccaaatgtgactttgaaaattgttagagaaaacaacattagaaaatggcgcaaaatcgttaggtcccaggagagaatgtgggggcgcaaacccttttcctcccagcctatttttgtaaataaaatgtttaaacttgaaatacaaatcgatgtttatatttcctatcattttgtattttatggtatttggtacatctggctgatactaagcacgaatagatattgatgttatggagtgctgtaatccaaagtttttaattgtgaggcatgttctgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgt

SEQ ID NO: 1840 - DNA, 3879 bp, Homo sapiens
gcacctgggcacctgggcagccgccgcggcgctggctagacgtgcgcgatggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacagctttgcgatcgtcatctggggcgtgctcacacagaagaagccgtttgcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagcttctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggtaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcacggaagatcagtgtcaacgccaaggatgaggaccagtggacagccctccactttgcagcccagaacggggatgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaagaaggccgtgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacactcctgcggcgaagcaagacctagctggctgcctgcggagaccgggggtccacgtggggctcttgtcctgtcctgtgttcctcgtggggatggaacgatcctgcgtggggccccgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatatatgacggtgggcagagaggcctgtcttaaagtttccatggaattgttttataaaatatcttaagagatgaataccttatcagctgttgcttgaaacctgttaaaaatgttcataacattggatagtctagtctctaaatgatggctaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcacccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaaaaaaaaaaa

SEQ ID NO: 1841 - DNA, 1816 bp, Homo sapiens
ccggcgtccgccccgctgccccctcccccgggggccatgggggcgcccccgggctaccggccctcagcttgggtgcatctcctccaccaactgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtggggacatgagtccccctgctgcccctgccacatcccagtgggctctgaccccctgatctcaactcgtggcactaacttggaaaagggttgatttaaaataaaagggaagactattttacaagc

SEQ ID NO: 1842 - DNA, 675 bp, Homo sapiens
atggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacgaatggttgagatgtttctggaatatcaaaatcagatcagcaggcaaaataagctcattcaagaaaaaaaggataacttgttaaaattgattgctgaagtaaaaggcaaaaagcaggaattggaagtactgactgcaaatatccaggatcttaaggaagaatattctaggaagaaggaaactatttctactgctaataaagcgaatgcagagaggttgaaaaggctgcagaaatctgcagacttgtataaagatcgacttggactagaaattcgaaaaatttatggtgagaaattgcagtttattttcactaatattgaccctaagaatcctgagagcccatttatgttttccttacatctcaatgaagcaagggactatgaagtgtcagatagtgcccctcatcttgagggcctagcagaatttcaagagaatgtaaggaagaccaacaatttttcagcttttcttgccaatgttcggaaagcttttactgccacggtttataattaa

SEQ ID NO: 1843 - DNA, 351 bp, Homo sapiens
atggagaaccaccattcacccaagggtcagaggaggtttcaaagaaaaggtgtcattggagcagtgttttgcagaatgagccagagttcaccaagcaggcaaggcaaggaagggtgttgcagagagggaacagcatatgcaaaggcatatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaa

SEQ ID NO: 1844 - DNA, 3737 bp, Homo sapiens
ggcgtccgcgcacacctccccgcgccgccgccgccaccgcccgcactccgccgcctctgcccgcaaccgctgagccatccatgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcagatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccagctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaggactaccaggaactcattgaagacatagttcgagatggcaggctctatgcatctgagaaccatcaggaaatacttaaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcacgggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctgaccaggcagaacaggcaagaggggagggaaggagacccctgcaggctccctccacccaccttgagacctgggaggactcagtttctccacagccttctccagcctgtgtgatacaagtttgatcccaggaacttgagttctaagcagtgctcgtgaaaaaaaaaagcagaaagaattagaaataaataaaaactaagcacttctggagacat

SEQ ID NO: 1845 - DNA, 1536 bp, Homo sapiens
atgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggaaatggccgggtgacagaattcaagtatggtgcaaaactcggcacagttattcgcaagtggaatggagagaagatgtcttacctaaagaactggggagaaggttggggtttcatgccttctgacagagcacttgtctttgtggataaccatgacaatcaacgaggacatggggctggaggagcctctattcttaccttctgggatgctaggctgtataaaatggcagttggatttatgcttgctcatccttatggttttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataa

SEQ ID NO: 1846 - DNA, 2110 bp, Homo sapiens
ggatccaagctattgtcctgcccatggcttcccatctcaggacgctctctggccgctatcatcccagcagtggagttcagcccactactctgaaccagccgcaggtggctgctatgggactgaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgtcctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggtgacagtgaggaagacaccgagctctcctgtacccgaggaggctgtctggccagccgcgtggcctcctgcagctgtgagctcctgactgatgcagtcgacctgccccgccccccagagacgacagccgtgggtgcagtggtgacagccccccacagccgaggtcgagatgccgtcagagaatccctgatccacgtcccgctagagacctttctgcagaccctggaatccccgggcggcagcggcagtgacagcaataacacaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttagggactgcaaaa

SEQ ID NO: 1847 - DNA, 2948 bp, Homo sapiens
aggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatttttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaaggcagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccaccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgagaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgtt

SEQ ID NO: 1848 - DNA, 14770 bp, Homo sapiens
gggacaccatcatttgggtttttaaaagcttcagcttctccagcatctttgcattgtgaatatcttcctgcttctagtcaaagctttctctctagtgattggaatgctgctgtaagcctattagaggtgcctgaggatatcaccttttacaaggaagccgtgtgtgcttgagaggatctttttaaatgcattatggctcatgcagcctcacaattaaagaaaaacagggatttagaaatcaatgctgaagaagagcctgagaaaaaaaggaaacaccgcaaacggtcccgggatcggaagaaaaagtctgatgccaatgcaagttacttaagagcagctcgagctggacaccttgaaaaggccctcgactacataaaaaatggagttgacatcaacatttgcaatcagaatgggttgaacgctctccaccttgcttccaaagaaggccatgtagaggttgtttctgagctgctgcagagagaagccaatgtggatgcagctacaaagaaaggaaacacagcattgcacatcgcatctttggctgggcaagcagaggtggtaaaagtcttggttacaaatggagccaatgtcaatgcacaatctcagaatggtttcacgccattgtatatggcagcccaggaaaatcacctggaagttgtcaagtttcttcttgacaatggtgcaagccagagcctagccacagaggatggcttcacaccattggcagtggctttgcaacaaggtcacgaccaagtcgtttcgctcctgctagagaatgacaccaaaggaaaagtgcgtctcccagctcttcatatcgcggcccgcaaagacgacacaaaagccgccgccctgctgctgcagaatgacaacaatgcagatgtggaatcaaagagtggcttcactccgctccacatagctgctcactatggaaatatcaatgtagccacgttgctgttaaaccgagcggctgctgtggatttcaccgcaaggaatgacatcactcctttacatgttgcatcaaaaagaggaaatgcaaatatggtaaaactattgctcgatcgaggagctaaaatcgatgccaaaaccagggatggtctgacaccactgcactgtggagcaaggagtggccacgagcaggtggtagaaatgttgcttgatcgagctgcccccattctttcaaaaaccaagaatggattatctccattgcacatggccacacaaggggatcatttaaactgcgtccagcttctcctccagcataatgtacccgtggatgatgtcaccaatgactacctgactgccctacacgtggctgcccactgtggccattacaaagttgccaaggttctcttggataagaaagctaaccccaatgccaaagccctgaatggctttacccctcttcatatcgcctgcaagaagaatcgaattaaagtaatggaactccttctgaaacacggtgcatccatccaagctgtaaccgagtcgggccttaccccaatccatgttgctgccttcatggggcatgtaaatattgtatcacaactaatgcatcatggagcctcaccaaacaccaccaatgtgagaggagaaacagcactgcacatggcagctcgctccggccaagctgaagttgtgcggtatctggtacaagacggagctcaggtagaagctaaagctaaggatgaccaaacaccactccacatttcagcccgactggggaaagcagacatagtacaacagctgttgcagcaaggggcatctccaaatgcagccacaacttctgggtacaccccacttcacctttccgcccgagaggggcatgaggatgtggccgcgttccttttggatcatggagcgtctttatctataacaacaaagaaaggatttactcctcttcatgtggcagcaaaatatggaaagcttgaagtcgccaatctcctgctacagaaaagtgcatctccagatgctgctgggaagagcgggctaacaccactgcatgtagctgcacattacgataatcagaaagtggcccttctgcttttggaccaaggagcctcacctcacgcagccgcaaagaatggttatacgccactgcacatcgctgccaaaaagaaccagatggacatagcgacaactctgctggaatatggtgctgatgccaacgcagttacccggcaaggaattgcttccgtccatctcgcagctcaggaagggcacgtggacatggtgtcgctgctcctcggtagaaatgcgaatgtgaacctgagcaataagagcggcctgaccccactccatttggctgctcaagaagatcgagtgaatgtggcagaagtcctcgtaaaccaaggggctcatgtggacgcccagacaaagatgggatacacaccactgcatgtgggctgccactatggaaatatcaagattgttaatttcctgctccagcattctgcaaaagttaatgccaaaacaaagaatgggtatacgccattacatcaagcagcacagcaggggcatacgcatataataaatgtcttacttcagaacaacgcctcccccaatgaactcactgtgaatgggaatactgcccttggcattgcccggcgcctcggctacatctcagtagtggacaccctgaagatagtgaccgaagaaaccatgaccacaactactgtcacagagaagcacaaaatgaatgttccagaaacgatgaatgaagttcttgatatgtctgatgatgaagttcgtaaagccaatgcccctgaaatgctcagtgatggcgaatatatctcagatgttgaagaaggtgaagatgcaatgaccggggacacagacaaatatcttgggccacaggaccttaaggaattgggtgatgattccctgcctgcagagggttacatgggctttagtctcggagcgcgttctgccagcctccgctccttcagttcggataggtcttacaccttgaacagaagctcctatgcacgggacagcatgatgattgaagaactccttgtgccatccaaagagcagcatctaacattcacaagggaatttgattcagattctcttagacattacagctgggctgcagacaccttagacaatgtcaatcttgtttcaagccccattcattctgggtttctggttagctttatggtggacgcgagagggggctccatgagaggaagccgtcatcacgggatgagaatcatcattcctccacgcaagtgtacggcccccactcgaatcacctgccgtttggtaaagagacataaactggccaacccacccccacatggtgaaaggagagggattagcagtaggctggtagaaatgggtcctgcaggggcacaatttttaggccctgtcatagtggaaatccctcactttgggtccatgagaggaaaagagagagaactcattgttcttcgaagtgaaaatggtgaaacttggaaggagcatcagtttgacagcaaaaatgaagatttaaccgagttacttaatggcatggatgaagaacttgatagcccagaagagttagggaaaaagcgtatctgcaggattatcacgaaagatttcccccagtattttgcagtggtttcccggattaagcaggaaagcaaccagattggtcctgaaggtggaattctgagcagcaccacagtgccccttgttcaagcatctttcccagagggtgccctaactaaaagaattcgagtgggcctccaggcccagcctgttccagatgaaattgtgaaaaagatccttggaaacaaagcaacttttagcccaattgtcactgtggaaccaagaagacggaaattccataaaccaatcacaatgaccattccggtgcccccgccctcaggagaaggtgtatccaatggatacaaaggggacactacacccaatctgcgtcttctctgtagcattacagggggcacttcgcctgctcagtgggaagacatcacaggaacaactcctttgacgtttataaaagattgtgtctcctttacaaccaatgtttcagccagattttggcttgcagactgccatcaagttttagaaactgtggggttagccacgcaactgtacagagaattgatatgtgttccatatatggccaagtttgttgtttttgccaaaatgaatgatcccgtagaatcttccttgcgatgtttctgcatgacagatgacaaagtggacaaaactttagagcaacaagagaattttgaggaagtcgcaagaagcaaagatattgaggttctggaaggaaaacctatttatgttgattgttatggaaatttggccccacttaccaaaggaggacagcaacttgtttttaacttttattctttcaaagaaaatagactgccattttccatcaagattagagacaccagccaagagccctgtggtcgtctgtcttttctgaaagaaccaaagacaacaaaaggactgcctcaaacagcggtttgcaacttaaatatcactctgccagcacataaaaaggagacagagtcagatcaagatgatgagattgagaaaacagatagacgacagagcttcgcatccttagctttacgtaagcgctacagctacttgactgagcctggaatgattgaacggagtacaggagcaacaagatccctccccaccacttactcatacaagccattcttttctacaagaccataccagtcctggacaacagctccgattacagtgcctgggccagccaagtcaggcttcacttccttatcaagttcttcctctaatacgccatcagcttctccgttaaaatcaatatggtctgtttcgacaccttctccaatcaaatccacattaggcgcgtcaactacatcttcagttaaatccattagtgacgtggcatctccaattagatccttacggacaatgtcttcgccgataaaaactgtggtgtcacaatctccatacaatatccaggtttcctctggtaccctggctagagctccagcagtcacggaagctacgcccttaaaagggctggcatccaattctacgttttcctctcgaacctctccagtgactacagcagggtctcttttggagaggtcatcaattactatgacaccccctgcctcccccaaatcaaacattaatatgtattcctcaagtttgccatttaagtcaattattacatcagcagcaccgctaatatcttcacctttaaagtcagtggtgtctccagttaaatcacgagttgatgtcatttcatcagccaaaattacaatggcatcttctctctcatcacctgtgaagcagatgcctggacatgcagaggtagcattagtcaatggatctatttcccctctaaaatatgcatcatcctcaactttaattaatggatgcaaagccactgccacgttacaggaaaaaatttcttctgctacaaactctgtgagctctgtggtcagtgcagccactgacacagttgagaaagtgttttctaccacgactgcaatgccattttccccactcaggtcatatgtttctgcagcaccatcagcttttcagtctctaagaactccttccgcaagtgcactctatacatcccttgggtcgtcaatatctgcaactacctcatctgtaacttcatcaattataacagtgccagtatactctgtagtcaatgttttgccagaaccagcattaaagaaacttccagactctaattcatttacaaaatcagcagcagccttgctgtcacccattaaaacattgactacggagacacatcctcagcctcacttcagtcgaacttcatctccagttaagtcatctttgttccttgcaccctctgcccttaagttgtctacaccatcttctttatcttccagtcaggagatactaaaagatgtagctgaaatgaaagaggacctaatgcggatgaccgcaatactacagacagatgtgcctgaggagaagccattccaacctgaactcccaaaggaagggagaatagatgatgaagaacctttcaaaattgtagagaaagtaaaggaagacttagtgaaagttagtgaaatccttaaaaaggatgtatgtgtagataataaaggatcacccaaatcaccaaagagtgacaaaggacactctcctgaagatgactggatagaatttagttcggaagaaatccgggaagccagacaacaagctgctgcgagccagtctccatctctgccagagagagtgcaagtaaaagcaaaagccgcctccgaaaaggattataacttgaccaaagttattgattacctaacaaatgatattgggagtagttcactgacaaacttaaaatacaagtttgaggatgcaaagaaggatggtgagggaggacagaaaagagttttaaaaccagcaattgctttgcaggaacacaaactcaaaatgcctccagcctccatgaggacttccacctctgagaaagaattgtgtaaaatggctgattccttttttggaacagatactattttagagtctcctgatgacttttctcaacacgaccaagataaaagtcccttgtctgacagtggctttgaaacaagaagtgaaaagacaccttcagccccacaaagcgctgaaacgactggtcctaaaccactttttcatgaagttcccatccctcctgttattacagaaacaagaactgaagtggttcatgttatcaggagctatgatccctcagctggggatgttccccagacccaaccagaggagcctgtgtcacctaaaccttcacctacttttatggaattggaaccaaagcccaccacctctagtattaaagaaaaggttaaagcatttcaaatgaaagccagtagtgaagaagatgaccacaatcgggttttaagcaaaggcatgcgtgttaaagaagagactcacataaccacaaccaccagaatggtttatcattctccaccaggcggtgaaggtgcatctgaaagaattgaagaaaccatgtcagtccatgacatcatgaaggcctttcagtccgggcgggatccttccaaagaactggcaggtctgtttgaacataagtcggcagtgtctccagatgttcacaagtctgctgctgaaacctcagcccagcatgcagagaaggacaaccaaatgaaacccaaactggagcgtataatagaagtccacatcgaaaaaggtaaccaagctgagcccactgaagtcattattagagaaaccaaaaagcatccagaaaaagaaatgtatgtatatcagaaagacttatcccggggagatattaacctaaaagattttctgccagaaaaacacgatgcttttccttgttcagaggaacagggtcagcaagaagaagaagaacttactgctgaagagtcattgccttcttatctggagtcttccagagtaaacactcctgtgtcccaagaagaagatagccgccctagttctgctcaactcatatctgatgactcttataaaacattgaagcttttgagtcaacactcaatagaataccatgacgatgagttgtcagaactaagaggggagtcttacaggtttgctgagaaaatgcttctgtcagaaaagctagatgtgtctcattctgatactgaggaatcggttacagaccatgcaggaccccctagctcagagttacaggggtctgataagcggtccagagaaaaaatagccactgcccccaaaaaagaaattctctccaaaatctataaagatgtttctgaaaatggtgtaggtaaagtgtctaaagatgagcattttgataaagtgacagtgttgcactattctggcaatgttagtagtccaaaacatgccatgtggatgcgctttactgaggacagattagacagaggtagagagaagttgatatatgaagatagggtggacaggactgtgaaggaggctgaagaaaaactgactgaagtgtcacagttttttcgtgacaaaactgaaaagctaaatgatgaactgcagtccccagagaaaaaggcacgccctaaaaatggcaaagaatattcttctcaaagccctaccagtagcagccctgagaaagtgctactgacagaactgctggcatccaatgatgagtgggttaaggcaagacagcatggccctgatggacaaggcttccccaaggccgaggagaaggcacccagtctgcccagcagcccagagaagatggttctctcccaacagactgaggacagcaagtccacagtggaagccaaaggaagtatttcacagagcaaagcaccagatgggccccagtctggattccagctcaaacaatctaaactcagttccattagattaaaatttgaacaaggcacacacgcaaaaagtaaggacatgtctcaagaagacagaaagtcagatggccagtccagaatcccagttaaaaaaatacaggagagcaagctacccgtctaccaagtttttgctagagaaaaacagcagaaggccatagacctcccagatgaaagtgtatctgtgcaaaaagattttatggtattaaaaaccaaagatgagcatgcccaaagcaacgaaattgttgtaaatgattctggctctgataatgtgaaaaaacagagaactgaaatgtcaagtaaagcaatgcctgactctttttctgagcagcaggctaaagacttggcatgtcatataacctcagatttagcaactaggggaccatgggacaaaaaggtctttagaacatgggagagttcgggagccactaacaataagtctcagaaagaaaaactttcgcatgtacttgttcatgatgtaagagagaatcacattggtcaccctgagagtaaaagtgttgatcaaaagaatgaatttatgtctgtgactgagagagaacgcaaattgttaacaaacggctctctctcagaaattaaagaaatgactgtaaaatctccctccaaaaaagtcttatatagggaatatgttgtgaaagaaggggaccatccaggcggattgcttgatcagccttccaggaggagcgagagctcagcagtgtcacacattcccgtcagagttgctgatgagaggagaatgctgtcttctaatattcccgatggtttttgtgaacagtcggcatttccaaaacatgaactatcacaaaaattgtcccagtcaagcatgagtaaagagacagttgagacacagcactttaattctatagaagatgaaaaagttacctattcagaaatcagcaaagtttccaaacaccagagttatgtaggtttatgcccacctctcgaggaaaccgaaacctcccccaccaaatctcctgattctttagagtttagcccaggaaaggaatctccctctagtgatgtattcgaccacagtcccattgatggattggaaaaactcgcaccactagcccagacagagggagggaaagagataaaaactttacccgtttatgtcagttttgtacaagtggggaagcaatatgaaaaggagatacaacaaggaggtgtaaaaaaaatcataagtcaggaatgtaagacagtacaagaaaccagggggaccttttatacaactagacagcaaaagcaacctccttctccccaaggtagtccagaagatgatactctagagcaagtatcctttctagacagctctgggaaaagccctttaaccccagaaacacccagttcagaggaagtgagttatgaatttacatctaagacacctgactcgctcatagcttatataccaggcaaacccagcccaattcccgaggtttctgaggagtcagaggaggaggaacaggccaagtcaacctcccttaagcagactacagtggaggaaacagcagttgagcgtgaaatgcctaatgacgtgagcaaagactctaaccaaagacccaaaaataacagagttgcctatattgaatttccccctcctccaccactggatgcggaccagattgagtcagataagaagcatcattatctcccagaaaaagaggttgacatgattgaagtcaatctgcaagatgagcatgacaagtaccagctggctgaacctgtcattagagtgcagccaccttcaccagttcctcccggggcagacgtcagtgattcaagcgatgacgaatctatttatcagccagtcccagttaaaaaatataccttcaaattaaaggaagtggacgatgaacaaaaagaaaaacccaaagcttctgctgaaaaggcttccaaccagaaagaactggaaagtaatggatctggaaaagataatgaatttggccttggccttgattcacctcagaatgaaattgcccagaatgggaacaacgaccagtccatcacagagtgttccattgccaccacagcagagttttctcatgacacggatgccacagagatcgactctctggatggctatgacctgcaagatgaagatgatggcttgacagagagtgattctaaactcccaattcaagccatggaaattaagaaagatatctggaacacagagggcattctgaagccagctgaccgctcttttagccaaagtaaacttgaagttatcgaggaggagggaaaggtgggaccagatgaggacaagccaccttctaaaagttcttcatctgaaaagactcctgataagactgatcagaagtcaggggcccagttcttcacactggaaggcagacatcctgacagatcagtgtttcctgatacttacttcagttacaaagtagatgaagaatttgccactccttttaaaacagtagctaccaaaggtctagattttgacccttggtctaataaccgaggggatgatgaagtttttgacagtaaatcacgggaagatgaaactaagccatttgggctggcggtagaagaccgctctccagcaacaacccctgatacaacgccagccagaacgccaactgatgaaagtaccccaactagtgagcctaaccccttcccatttcatgaaggaaaaatgtttgagatgactcgcagtggtgcaattgacatgagcaagagggattttgttgaagagaggctccaatttttccagattggtgagcatacttctgaagggaagtcaggggaccagggggaaggggataaaagtatggtcactgccacaccacagccacagtcaggggacaccactgtagaaaccaatctagagagaaatgtagagacacctacagtggaacctaaccccagcatcccgaccagcggagagtgtcaggaaggcacatccagtagtggctccctggagaaatcagcagcagccactaacacctctaaagttgaccccaagttgcgcacgcctataaaaatgggaatttctgcatccaccatgaccatgaagaaagaaggccctggagaaataacagataagatagaagcggtgatgaccagttgtcagggattagaaaatgaaactataacaatgatttcaaatacagccaatagccagatgggcgttaggccccatgaaaaacatgattttcaaaaagataactttaataacaacaacaatttggattcttccactatacagacagataacattatgagtaatatagttctgacagaacattctgcacccacttgtaccacagagaaagataacccagtgaaagtctcatcaggaaaaaagacaggggtactacaaggacactgtgtaagagataagcagaaagttcttggagaacagcaaaaaacaaaggaattgatagggattaggcaaaaatccaaacttcccataaaggccacttcaccaaaagataccttcccaccgaaccatatgtcaaacactaaagcaagtaaaatgaagcaggttagtcaatccgagaaaaccaaagcccttactacttcttcatgtgtagatgtaaagtccagaattccagtgaaaaacacacccagggataacataattgcagttagaaaagcatgtgccacacaaaagcaagggcagccagagaaaggcaaggccaaacagcttccatccaagttgccagtaaaggtaagatccacctgtgtcactaccaccaccaccactgccaccaccaccaccactaccaccactaccaccaccaccagctgcacagttaaagttaggaaaagtcagctcaaggaagtatgtaaacattccattgaatattttaagggaattagtggtgagaccttaaagcttgtggaccgcctctctgaagaagaaaaaaagatgcagtccgagttgtccgatgaggaagaaagtacctcaagaaacacgtcgttgtccgagacttcccggggtggccagccttcggttacaacgaagtctgctagagataagaaaacagaggcagcacctttaaaatcaaagagtgaaaaggccggcagtgagaaaaggagcagtagaaggactggtccacagagtccatgtgaacggacagatatcaggatggcaatagtagccgatcacctgggacttagttggacagaactggcaagggaactgaatttttcagtggatgaaatcaatcaaatacgtgtggaaaatccaaattctttaatttctcagagcttcatgttattaaaaaaatgggttaccagagacggaaaaaatgccacaactgatgccttaacttcggtcttgacaaaaattaatcgaatagatatagtgacactgctagaaggaccaatatttgattatggaaatatttcaggcaccagaagttttgcagatgagaacaatgttttccatgaccctgttgatggttggcagaatgagacatcaagtggaaacctagagtcctgcgctcaagctcgaagagtaactggtgggttactagatcgactggatgacagccctgaccagtgtagagattccattacctcatatctcaaaggagaagctggcaaatttgaagcaaatggaagccatacagaaatcactccagaagcaaagacaaaatcttactttccagaatcccaaaatgatgtaggaaaacagagtaccaaggaaactctgaaaccaaaaatacatggatctggtcatgttgaagaaccagcatcaccactagcagcatatcagaaatctctagaagaaaccagcaagcttataatagaagagactaaaccctgtgtgcctgtcagtatgaaaaagatgagtaggacttctccagcagatggcaagccaaggcttagcctccatgaagaagaggggtccagtgggtctgagcaaaagcagggagaaggttttaaggtgaaaacgaagaaagaaatccggcatgtggaaaagaagagccactcgtaacagcgaacggtcagtcaaggatcataagtttttactgccagtattgagaaattcgtggaagaaatgtcagcaggaagtaaaaattcaccgagaagtgtgtgtgtgttcgctgcttccacacattaatggcatgattttttttatgcaaaaagaaaagaaaagaaaaccacccacattttaatttagcatgagccaatttacagagcatggaaatcactttcatttccggattggcgcgtgtgcaattagcaatgcagtgtatatacaagaagccatgctgttaacagtttatctcaagtaatttggtgtcatttacaaaaggaagaaattcttgccatcagaagggacagaaggagatggaatgatcaaatcacagagaaacactaaaattactaaatctacaacagctcgccttatttttcttggacccaaactgtcagggtataaacactatttgtttcttttttaaaacatcgatagttttgctgtaaataataacactgtataaattctaacagaaaaatagaataaaatgttgataaggcactgcctcttagaacacaaacagaatattgcaaatgcatttaacaaataggggtctcaagtgacttcaccctagaagaggagggagggattctgggtgggggtgactcttcactgattcttgtatattagcaattataatgtttgtatatgcaaaactgctagcttgattttaaaaaaaaacaaatctttaaaatctgctgcaaatttaaataattcccaaaatgaggaattctgtagttctgtgaaaaatttttttcttcagaatactaatattttgatgcatgtgtatcaccttattttgattaaatcttttccaattttgcaaacactacagtatactgcaacacaaaagattttatctgtaaacacaaagcccttcatctaatatttgttgctattgccaatttttcaatgaaatgacctaaaaacaacaaaaaaaaataacctatacggtagttgctttagggggtggggggatgctatctgttagtgcttaaaagggggtaaatgcttgccgctttagaggtggatggtgctcataaaaggccccagtcgggggtatttaaaaaggactgaacagaaatccttagctagtagaatggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagcataaaataaattgtgttaaactcttcacct

SEQ ID NO: 1849 - DNA, 609 bp, Homo sapiens
atggctactctgatctatgttgataaggaaaacgaagaaccaggcatccttgtggctacaaaggatgggctgaagctggggtctggaccttcaatcaaagccttagatgggagatctcaagtttcaatatcatgttttggcaaaacattcgatgctcccacatccttacctaaagctaccagaaaggctttgggaactgtcaacagagctacagaaaagtcagtaaagaccaatggacccctcaaacaaaaacagccaagcttttctgccaaaaagatgactgagaagactgttaaagcaaaaaactctgttcctgcctcagatgatggctatccagaaatagaaaaattatttcccttcaatcctctaggcttcgagagttttgacctgcctgaagagcaccagattgcacatctccccttgagtgaagtgcctctcatgatacttgatgaggagagagagcttgaaaagctgtttcagctgggccccccttcacctttgaagatgccctctccaccatggaaatccaatctgttgcagtctcctttaagcattctgttgaccctggatgttgaattgccacctgtttgctgtgacatagatatttaa

SEQ ID NO: 1850 - DNA, 1281 bp, Homo sapiens; identical to SEQ ID NO: 112

SEQ ID NO: 1851 - DNA, 876 bp, Homo sapiens
atggaggcgcccgccagcgcgcagaccccgcacccgcacgagcccatcagcttcggcatcgaccagatccttaacagcccggaccaggacagcgcacccgccccgcggggccccgacggcgccagctacctgggagggccccccgggggccgtccgggcgccacatacccgtctctgcccgcctcctttgcgggccccggcgcgcccttcgaggacgcgggatcttacagtgtcaacctgagcctagcgcccgcaggcgtgatccgggtgccggcgcacaggccgctgcccggggccgtgccgccgcctctgcctagcgcgctgcccgctatgccctcggtgcccacggtctccagcctagggcgtctcaatttcccctggatggagagcagtcgccgctttgtgaaagaccgcttcacagcggcggccgcactcacgcccttcaccgtgacccggcgcatcggccacccctaccagaaccggacgccgcccaagcgtaagaagccgcgcacgtccttttcccgggtgcagatctgcgagctggaaaagcgcttccatcgccagaagtacctggcctctgccgagagggcggcgctcgccaagtccctcaaaatgacggacgcgcaggtcaagacctggttccaaaaccggaggaccaagtggcggcggcagacggcggaggagcgggaggcggacgggcagcaggcgagccggctcatgctgcagctgcaacacgacgccttccaaaagagcctcaacgactccatccagcctgacccgctctgtctgcacaactcgtcactctttgctctgcagaatctgcagccctgggaggaggatagttccaaggttcccgctgtcacctctctggtgtga

SEQ ID NO: 1852 - DNA, 381 bp, Homo sapiens
atgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaa

SEQ ID NO: 1853 - DNA, 393 bp, Homo sapiens
atgtccggacgcggcaagcaaggcggaaaggcccgagctaaggctaagacccgctcttcgcgggccggactccagttccctgtgggccgcgtacaccgcttgctccgcaagggcaactactccgagcgagtcggggccggcgcgccagtgtatctggcggcggtgttggagtacctgaccgccgagatcctggagctggcgggcaacgccgcccgcgacaacaagaagacccgcatcatcccccgacacctgcagctggccatccgcaacgacgaggagctaaacaagttgctgggtaaagtcacaattgctcagggcggtgttctgcccaacatccaggctgtactgctccccaagaagactgagagtcaccacaaggccaagggcaagtaa

SEQ ID NO: 1854 - DNA, 639 bp, Homo sapiens
cgcgcgcccgaacgaagccgcggcccgggcacagccatggcccggcgggcggggggcgctcggatgttcggcagcctcctgctcttcgccctgctcgctgccggcgtcgccccgctcagctgggatctcccggagccccgcagccgagccagcaagatccgagtgcactcgcgaggcaacctctgggccaccggtcacttcatgggcaagaagagtctggagccttccagcccatcccattggggacagctccccacacctcccctgagggaccagcgactgcagctgagtcatgatctgctcggaatcctcctgctaaagaaggctctgggcgtgagcctcagccgccccgcaccccaaatccagtacaggaggctgctggtacaaatactgcagaaatgacaccaataataggggcagacacaacagcgtggcttagattgtgcccacccagggaaggtgctgaatgggaccctgttgatggccccatctggatgtaaatcctgagctcaaatctctgttactccattactgtgatttctggctgggtcaccagaaatatcgctgatgcagacacagattatgttcctgctgtatttcctgcttccctgttgaattggtgaataaaaccttgctctt

SEQ ID NO: 1855 - DNA, 3162 bp, Homo sapiens
gcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcatcgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttgcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagcccacagggctgcagcggttctattccttgtcttacttatggtacagtgctcacaactccaccacagtgattgtggtgggcctgattgtcagtctactcactgggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggacctaaaaaaaaaaaaaaaaaa

SEQ ID NO: 1856 - DNA, 1237 bp, Homo sapiens
gaattcggcacgaggcctcgtgccggggagcaacctcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggcgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctaaagtatgttattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaaatgggggaaggggtgctccttaaatatatatagatatgtatatatacatgtttttctattaaaaatagccagtaaaaaaaaaaaaaaaaaaaaa

SEQ ID NO: 1857 - DNA, 453 bp, Homo sapiens
gcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggca

SEQ ID NO: 1858 - DNA, 384 bp, Homo sapiens
acgagccgccgccatgatcatccctgtacgctgcttcacttgtggcaagatcgtcggcaacaagtgggaggcttacctggggctgctgcaggccgagtacaccgagggggacgcgctggatgccctgggcctgaagcgctactgctgccgccggatgctgctggcccacgtggacctgatcgagaagctgctcaattatgcacccctggagaagtgaccacgctgaaacccacccacccgctgtgctgaccatgggccctgagcgtcctaccccgaattcacgaggctgaggcatccgggagctggcgtaatgcctggccgcagtgtgtgtgtatcccataccccactctggaaggaaccatccagtaaaggtctttcagaacc

SEQ ID NO: 1859 - DNA, 1224 bp, Homo sapiens
gtttccgggttgagtctggactcctaccgaactcgggcaagttatttaacacccctgagcttctttcttcatctgcaaaatggaacccctcccttcctttgaattgctgagcccattacgcgaggtaacgttgtacgacgctctctgcacagcgccaggtcccaatcccggtgttccggctcagcaggccaggagcgtttccagtttccattgcgtttctctttctgaactcttcttgcccctctcctgggaagctccccgattcttcttggcccttccttcccttccacagctccctctccaccctaagcccagcgggcccgcctccccccctccttcccggcaggtgacggcggaatcccgctgtaagctgctcagctggctgatcccggtgcaccgccaattcggcctctccttcgagtcgctgtgcctgacggtgaacactctggaccgcttcctcaccaccacgccggtgctgcagactgcttccagctgcttggggtcacctccttgctcatcgcttgcaaacaggtggaggtgcacccgccgcgcgtggaagcagcttctggccctctgctgcggcgccttctcccggcagcagctctgcaacctcgagtgcatccgtgctgcacaagctgcacttcaccctgggtgcgccaccattagcttcttcctgacatttcagcacctcctgagcgcagctaggcctccgaagctctggaagcgcaagccctggcgccggggggtggcagagctgagtctggccgactatgccttcaccagctactccccttccctcctggcgatctgctgcctggcgctggcggaccgcatgctgcgtctcgcggcccgtggacttgcgactgggagaccacccggaggcggcgctggaggactgtatgggcaagttgcagctgctggtggccataaacagtacttccttgactcacatgctgcccgttcagatctgcgagaagtgcagcctgcccccgagctcgaaataaaacagatccttcgtttccttttagtccctggcccggctgctggacctctcccgtagcctcagaagagtgcagtactggtccacagagaaggcttcaggacctgcttggtcagctgcaggttgtaaatagtgtacgatactagcatctggtattttatttattttgcagcgagcacatgaggaagctgagtctttcaccaataaacagttgtggtttgtct

SEQ ID NO: 1860 - DNA, 3152 bp, Homo sapiens; identical to SEQ ID NO: 138

SEQ ID NO: 1861 - DNA, 1111 bp, Homo sapiens; identical to SEQ ID NO: 205

SEQ ID NO: 1862 - DNA, 3054 bp, Homo sapiens
tcggcacgagcgtggctcggttcttgtgagcgaagctttgtccggttcggcaatggacggaatcgtcactgaagttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgctttttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctggcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaaccttttcgtacacactcttgtgggacgtatcatataaatgtcagcactaagtaatgtcttgtttgtggctgaatatttttcgtagatgtttttgaagttgacatgacttacgtgcatttaaatatatattgccatcccttagtttgtaattaagatttggaatatggttgtggatttctgagcatgtgcagactggtctagctagttccaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaacaaaaaaaaaaaaaaaaaa

SEQ ID NO: 1863 - DNA, 2655 bp, Homo sapiens
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggagccatccctaagcagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcacgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagacccctaaaaaaaaaaaaaaaaaa

SEQ ID NO: 1864 - DNA, 2402 bp, Homo sapiens
aagagaggaaggcttaaagagccagactgcgcagccaggactggggtatgggcgctgtcctgcaggccaaagaatgaagatgtagccccgcccccaacctaggaggaggaccagcccggttcctgtcctgcccccgcaacctcgccccgattccactccgggaacctcggcgatgctgagccaagaccacttctgaatcagggatgacttgtctagtgaacgtagggtcagagccatcagttggaaaggctgggaggagcctggagaaagaggcgaccttccttgggatctgtgcgctccctccttgcctccccctccagcctcccacttggtagcaccttcctgatccccttatctctaaggcgctcagggaaatgccccgctgcgggagccttctgggaaatgctgccctggccacccaggaaccatgagccctgcagccccggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggccccagctggagccaccgtccctcccaggagccgccgggtttgctccaaggtcaggtgtgtgacccgctcgtggagcccctgtaaggttgagaggcggatctgggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttatagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggttctagcagtaaaaaaaaaaaaaaaaaaaaaaaaaaaa

SEQ ID NO: 1865 - DNA, 660 bp, Homo sapiens; identical to SEQ ID NO: 168

SEQ ID NO: 1866 - DNA, 3097 bp, Homo sapiens; identical to SEQ ID NO: 341

SEQ ID NO: 1867 - DNA, 1956 bp, Homo sapiens; identical to SEQ ID NO: 203

SEQ ID NO: 1868 - DNA, 408 bp, Homo sapiens
tttttgtcgtttttggttttttttgagacagcgtcttagtctgtcgccaaggctggagtgcagtggcgcaatcaaagcttgctgcagccttgaactcctgggctcaagcaatcctcttacctcagcaactaggactacaggcacatgccaccacgcttggccttctaatttatttctgtgtcaacaaaataaaactcaggcctaggaatagcttggttcagaaatcacagagggacttagtattccattaatacaaatggaaacattaagttcatcatcagatgataaaaggaaaaaaaaaaacctgatactcatctcaaaagacggcggaaaagacatttggcataaatccaggtacctattattatttccaaatttaaaaacttcttcttttttaaggggtagggg

SEQ ID NO: 1869 - DNA, 895 bp, Homo sapiens
agagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagatgtgcttttccagactgatccaactgcagagatggcagctgagtcattgcctttctcttcggacactgtcagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctat

SEQ ID NO: 1870 - DNA, 2574 bp, Homo sapiens
cctggcgcagccgcagcagcgacgcgagcgaactcggccgggcccgggcgcgcgggggcgggacgcgcacgcggcgagggcggcgggtgagccgggggcggggacgggggcgggacgggggcgaagggggcggggacgggggcgcccgccggcctaacgggattaggagggcgcgccacccgcttccgctgcccgccggggaatcccccgggtggcgcccagggaagttcccgaacgggcgggcataaaagggcagccgcgccggcgccccacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattatttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcatttattgctgagttatatgttcactgtccccctaatattagggagtaaaacggataccaagttgatttagtgtttttacctctgtcttggctttcatgttattaaacgtatgcatgtgaagaagggtgtttttctgttttatattcaactcataagactttgggataggaaaaatgagtaatggttactaggcttaatacctgggtgattacataatctgtacaacgaacccccatgatgtaagtttacctatgtaacaaacctgcacttatacccatgaacttaaaatgaaagttaaaaataaaaaacatatacaaataaaaaaaa

SEQ ID NO: 1871 - DNA, 3068 bp, Homo sapiens
aacggtatcgataagcttgatatcgaattccgcacccccggctcggggctgtgagcggctcggggccgggggtgggcggcggtgcggcgggcggccgacgctcctcttcggcggcggcggcggcggcggcccatgcgtggggcggcgcggctggggcggccgggccggagttgcctcccggggcccgcgctgagggccgccgccgcgcccgccctgctgcttgctcgttgcgctgttgccgctgctgccggcctgcgtgccgccgcccgtccgcggcccccggagctgcagtcggcttccgcggggcccagcgtgagtctctacctgagcgaggacgaggtgcgccggctgatcggtcttgatgcagaactttattatgtgagaaatgaccttattagtcactacgctctatcctttaatctgttagtacccagtgagacaaatttcctgcacttcacctggcatgcgaagtccaaggttgaatataagctgggattccaagtggacaatgttttggcaatggatatgccccaggtcaacatttctgttcagggggaagttccacgcactttatcagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaaaacttgaagaagtaaaaacttcagccttggacaaaaacactagcagaactatttatgatcctgtacatgcagctccaaccacttctacgcgtgtgttttatattagtgtaggggtttgttgtgcagtaatatttctcgtagcaataatattagctgttttgcaccttcataatatgaaaaggattgaactggatgacagcattagtgccagcagtagttcccaagggctgtctcagccatccacccagacgactcagtatctgagagcagacacgcccaacaatgcaactcctatcaccagttatcctaccttgcggatagagaagaacgacttgagaagtgtcactcttttggaggccaaaggcaaggtgaaggatatagcaatatccagagagaggataactctaaaagatgtactccaagaaggtacttttgggcgtattttccatgggattttaatagatgaaaaagatccaaataaagaaaaacaagcatttgtcaaaacagttaaagatcaagcttctgaaattcaggtgacaatgatgctcactgaaagttgtaagctgcgaggtcttcatcacagaaatcttcttcctattactcatgtgtgtatagaagaaggagaaaagcccatggtgatattgccttacatgaattgggggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtgtgggcctttggagtgaacagcttgtgggaactcatgactctgggccagactccctacacgttggacattgaccccttcgagatggcggcatacctgaaagatggttaccgaatagcccagccaatcacctgtcctgatgaattatttgctgtgatggcctgttgctgggccttagatccagaggagaggcccaggtttcagcagctggtacagtgcctaacagagtttcatgcagccctgggggcctacgtctgactcctctccaatcccacaccatcaggaagaaggtgcctgtcggggctcacttgaagcctgtcagggatgctttgtatatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagggccaactgctttttatttttttacttcatcaaggtgatgtaagtgactttgtttagacacagatatttggaattagcctatcttagtgccaactgctttttatttttttccttcatcaaggtgatgtaagtgactcacctttaaagtttttttagtgttattttttatcactactctgggaaatggtttgtcttcaagatgcaatacttttcttagataaggaaaaacagcataaaaagatacctggtctgccttgtacaagaaaaccgaatattagaggaagaaaatttaaagaaaagctagagaaaaaaaaaattttttaaaaaatacttattagaagcaaactgcccttgcatggaaaactgtttatttttttcagtgaaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggtaagatcccttttatgcacctagaatatgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatattaaaaaaaaaa

SEQ ID NO: 1872 - DNA, 1682 bp, Homo sapiens
atgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctaccctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtgtgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatg

SEQ ID NO: 1873 - DNA, 3505 bp, Homo sapiens
aggaatgagggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcatttttttttttttgacatctttctgtggcaaacctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgagggtatgaaactttcattggtcccatcgttgtgcgcagggtgcaactggctacctagaagctgatggcaggagactgttcacacacaggagattgtgagctgtgtaagtagtcatcgccactcaagtaggacaagggtcctacccaaggctaggaccgcctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtgtcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatcctttagagcacatc

SEQ ID NO: 1874 - DNA, 6868 bp, Homo sapiens
gaattccagagggccgcctttcggcagaacacacctcttctttggtgccttctctgcatatcaccacactgggtcaagagcaagccatcctttctggggcggttcccgcatcaccatcaactgggacagccgactttccctccatacttactttcctccagcccacagagaatcatgcctccccatctcctgtgccagaaatgcccactcttccagcagagggcagtgatgggtcccctcctgcaactagagacttgctcctctcaagcaaagttcctaatcttctttccacatcttggacatttccccggtggaaaaaggacagtgtgacagccattttagggaagaatgaagaggcaaatgtgacgattcctctccagggctttccaaggaaagaggttttgagtcttcacactgtaaatggatttgtctctgatttcagcaccggtagtgtctcatctcccatcattacagcaccaaggacgaatcccctttcttcaggaccacctctaccttccatactctccatacaagccacccagactgttttcccatctctcttggctttttccagcaccaagccagaggtttatgcagctgctgtggaccattctgggttgccagcttcagctcccaaacaggtgagagcatcgccctcctccatggatgtatatgattccttaacaataggagacatgaaaaagccagcaaccacagatgttttctggagttctctttcagcagaaactggatctctttccacagaatcaataatatctggcttgcagcagcaaacaaattatgatttaaatggacacacaattagcaccacaagttgggaaactcatttagctccaacagctcctcccaatggtttaacttcagctgccgatgccataaaatctcaggatttcaaagatactgctgggcattcagtgactgcagaagggtttagtattcaggatctagtcctcggtacaagcattgagcagcctgtgcaacagtcagacatgaccatggttggaagccatatagacctctggcccacaagcaataacaaccattccagagacttccaaacagctgaagttgcatattactcacccacaactcgacattccgtgtctcatcctcagctacagttgcccaaccagccagcacatcctcttttgctaacctcaccaggaccaacttctacaggtagcttgcaggaaatgctttcagatggaacagatacaggttctgaaatttccagtgacatcaattcatcacctgagagaaatgcttccacaccattccagaacatcttgggatatcactctgctgctgaatcttctatatcgaccagtgtctttcccaggacctcctccagagtgctgcgggcttctcagcaccccaagaaatggacagcggacacagtatcatctaaggtacagccaacagcagcagctgccgtcacattgtttctgaggaaatcaagtccacctgcactgtctgcagccctggttgctaagggcaccagcagcagccctttggccgtggcctcaggaccagctaagagcagttcgatgactactcttgctaaaaatgtcacaaacaaggccgcatctggcccaaagaggacaccaggggcagtccatacagccttcccattcacaccaacctacatgtatgcaagaacaggacataccacgagcacacatacagccattgcaaggaaacatggacactgcctctggcctgttgtctacaacttacctcccccaggaaaaccacaagccatgcacaccggcctcccaaaccccaccaacctggagatgcccagagcatccacgccacgcccactgacagtcacggccgcgctgacatccattacagcctcagtgaaggccacccggttgccaccattgcgagcagaaaacacagatgctgtccttcctgctgcatcggctgcagtggtcacgactggcaaaatggcatccaacctggagtgtcagatgtccagtaagctcctggtgaagacagttctctttctcacccaaaggagagtgcagatcagtgaatccttgaagttcagtatcgccaaagggctcacacaggcattgcggaaggctttccaccagaacgatgtctcagctcacgtggacattctggaatattctcataatgtcacagttggttattatgctaccaaagggaagttggtgtatttgcctgctgtggtgatcgaaatgctgggtgtgtatggagtcagcaacgtcactgcagacctgaagcaacacaccccacacttacagtctgtggcagtacttgcctccccatggaatccccagcctgcaggctacttccagctaaaaacagtgctgcagtttgtgagccaagcggacaacatacagtcctgcaagtttgctcagacaatggaacagaggctgcagaaggcattccaggatgccgagaggaaagtcctgaataccaaaagcaacttgacaattcagattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccattgctgaaccactggaatatcccaaccttgacatatcagaaacaaccagagactattgggtaattacagtgctgcagggtgtggacaattcgctggtgggcctgcacaaccagagctttgcccgggtcatggagcagcgcctggcccagctattcatgatgtcccagcaacaaggccggcggtttaaacgggccaccaccctgggaagctacactgtgcagatggtgaagatgcagcgtgtcccaggcccgaaggacccagcggagctgacttactataccctgtacaacgggaagcctttgttggggaccgtagctgccaagatcctgagcaccattgattcccaaaggatggccttgacccttcatcacgttgtccttctgcaagctgaccccgtggtgaagaacccgcccaataacctgtggatcatcgctgcagtgctggcgcccattgccgtggtcacggtcatcatcatcatcatcactgccgtgctctgcaggaagaacaagaacgacttcaagcctgacaccatgataaacctgccgcagagagcaaagcctgtgcaaggctttgattatgccaagcaacacctgggccagcaaggggcagatgaggaggtcatccctgtgactcaggagacagtggttctcccactgcccattagagatgctcctcaggaaagagacgtcgctcaggatggaagcaccatcaagaccgccaaatccactgaaaccaggaagagcaggtcgcccagtgagaatggctctgtcatcagcaacgaatcagggaagcccagctcagggagacgctcaccccagaatgtaatggcacagcagaaagtgacaaaggaggaggcaaggaagagaaatgtgccagcgagtgacgaagaggagggagcggttctatttgacaactccagcaaggtggccgctgaaccctttgacacatcttctgggtctgtgcagctcattgccataaaacccacagccctccccatggtgccccccacctcggacaggagccaggagtcatcggcagtcctcaacggcgaggtgaacaaagccctgaagcagaagtcagacatcgagcactatcggaacaagctgcgcctcaaagccaagaggaagggatattacgacttccctgcagtggagacgagcaagggtctgaccgaaagaaagaagatgtatgaaaaagccccgaaggaaatggagcatgttttggatccagattcagaactctgtgctccattcaccgagtctaaaaacaggcaacagatgaagaactctgtctacagaagccggcagtctctgaacagcccgagtccaggggaaaccgagatggaccttctggtgactcgggagcgaccccggcgtggaatccgcaacagcggatacgatactgagcctgaaatcatagaggaaaccaacattgacagagttcctgagccccggggctattccaggtctcgacaggtgaaaggccactcggagacctccacactgagctcccagccatccatcgacgaggtcaggcagcagatgcacatgctgctggaggaggccttcagcctggcatccgcgggccacgcaggccagagccggcaccaagaggcctacggctcagcccagcacctgccctattcggaggtggtgaccagcgctccggggaccatgacgcggcccagggccggggtgcagtgggtgccgacctaccgcccagaaatgtatcagtacagtctgccccggccggcttacaggttttcccagcttcctgagatggtcatgggctcaccgcctccacccgtacctccccggactggtcctgtggctgtcgcttctctcaggcgatccacctcagacatcggcagcaagaccagaatggccgagtctacagggcccgagccggcccagctgcacgacagcgcctccttcacgcagatgtccagaggccctgtgtccgtgacgcagttggatcagtcggctttaaattactcaggtaatacggtgccagcagtgttcgccatcccagctgccaacagacctggcttcaccggctacttcatcccaacgcctccctcatcctataggaaccaggcctggatgtcctatgcaggagagaatgagctcccgagccagtgggcagattcggtgcccctcccagggtacatcgaggcctacccccgatcacggtacccccagagctctccctccaggcttcctcgtcagtacagccagccagccaacctgcaccccagcctggagcaggccccggcgccctccacagcggcctcgcagcagagcctggcagaaaacgacccgtctgacgctcccctgaccaacatctccactgcggcccttgtgaaggccatccgggaggaggtggccaagctggccaaaaaacagacagacatgtttgagttccaggtctaacgccttagccccgtgggactctggacttccaaactctgaggactcagcctttgggtttcccatgcctacgtgttaggacttgagacatagcaatgggtgagtctttctcaccctccatttctgaaaaggtgaactatggggcttctgggaacaggaaactcttgaacgactagattcttggctcatccaactgattgtgggtcaagtccctggcttggggccttatgtttgatactctctcatgtcaaatgtttgaactttgggcatgtgccctatggaagcttagtcacaagaggcactagctaatctacagattcctatccaatgccacattttaataaatcaccggaagcgggagaatgtagctcttatcttcggtgacctctgcatgttaactctgtttctgtgttaaaggcaatgcaggagtgtggattaagcaccagactgtattctcattcaaccatgaccgtgcgcattaaaatcagtttgtaagggagacactgactccagccaagaaacctgagccccttttttttaggttcatattcaaagtcaaatgaactggatgaaagtcagtaccaatggctgtgcctataaatagacctgattctttgtttccctcgtcaattaaacaaaggccaagaaagagagaagatgagagggaatggtggatttgcgttgacagattttttaaaaggtgttgccattttggaaataaaagtcccctacaagttaggatctaactgaaagagaatcggtgctaagagcttttaggatcctacaaaagaaacacagttatttgtgaaggtttttctttgccttgttttgaaggtggcctgaggaatggagcttctctttttcttgggataatagatacatcaacttttacaagaaaatctctgtctcttcaacaatgatgtccagtgtgtgctgctgagtggtacaaaaggaaatagtacttgaaacctgttagaaacaggagtggtagaaccacagtcttcccaggccgcagcctctgtttatagaagcttctgaatgtagaaaagctgttgaatttcatttaaatgtaaataaccttttaaaaagcgtatggagttagccagttccccctagttaatggacataggaagacatttgctgaaatggtagggtggccactttgtgaccatgatgttgcaagttgccctccctggcatggtgagttggcttccagagctgtgggtagaggacatcgcctcacggcactgaggcaccagccgctgcctacccatcaatgcaagcaaaacagctactgactttgtgtagcagggagattggggactctggttccctcgccaagtgtggcagcctgtgcagtgttgggggcttacttggtattctgttggagaatgaggtcctgtcctgctttcacccatgacccatctagcttcagctgtatccattttcttctgagcccatcttccattgtcctcaacgagtttctttggtctttactgaaagaagatagtagaaatttaaaagttgagagaagactagaaatggaactgattagaaggggaggttcaaactgtcaatgcacagacttttcaaagaagttgtttatattttccaatggcaaactgccctttctggaatgttcagagatgatgtgtcatggaaccttcaaacaagtctcttgttcggatgataataggtagtgtccttttagtatgctggttgatctttcatagtgttagtgttttgttacttaaaaaggaaatcagctataaataaaatgtatttttgta

SEQ ID NO: 1875 - DNA, 2280 bp, Homo sapiens
ccgcccgccaccagctacgccccgtccgacgtgccctcgggggtcgcgctgttcctcaccatccctttcgccttcttcctgcccgagctgatatttgggttcttggtctggaccatggtagccgccacccacatagtataccccttgctgcaaggatgggtgatgtatgtctcgctcacctcgtttctcatctccttgatgttcctgttgtcttacttgtttggattttacaaaagatttgaatcctggagagttctggacagcctgtaccacgggaccactggcatcctgtacatgagcgctgccgtcctacaagtacatgccacgattgtttctgagaaactgctggacccaagaatttactacattaattcggcagcctcgttcttcgccttcatcgccacgctgctctacattctccatgccttcagcatctattaccactgatgcacaggcgccaggccaagggggaaatgctctttgaaagctccaattattggtccccaaaagcagcttccaacgtttgccatctggatgacaaacggaagatccactaaaacgtccacgggattaacagaacgtccttgcagactgagcgatgacaccacactttgtttggacatttaaattcactctgctgaataggaggaagcttttctttttcctgggaaaacaactgtctcttggaattatctgaccatgaacttgctcttctagacaactcacatcaaagccctcactccactaatggagaatcctagccccactaatgccaagtctgtttggggattttgcctcagctatgggcttccctagagtaggtctaggggaatactcagtctgatcttttttttgtttgttttattttgttttttttgagacggagtctcgctcttcctccaaggctggagtgcagtgacgcgatctccactcactgcaggctccgcctcccgggttcccgccattctcctgcctcagcctcccgagtagccgggactacaggcgcccaccaccatgcccggctaatttagttgtatttttagtagagatggggtttcaccgtattagccaggatggtctcgatctcctgacctcgtgatccgcccgcctcggcctcccaaagtgctgggattacaggcgtgagccaccgtgcccggcctgattctcttaaaattgaagaggtgctgccaaggccttcagatctaacgcagatgcatagaccttgttcctggtacttgttcagcctgtgctggggagccgtggtcccgagttccctgggaggctgacagggtcaagccaccctgcccaccaccctcccacttcccctcccctttcctctccagcattaggattcaagggaaatctgcatgaagccaattttgagggtagacgtgtggggaaaataaatcattatacagtaagacctggggcttgaggggtggggaatggggagggaagggcatagcctgctcctccatgagtctgacatctcggaaactgagcagctgccggacgcctgggtcaggaatccaagaccccacctcttaaggactggttcctcagaaagcaccctcagggaaaaaggtgaaaacattacatccgtggattctcctgccacaaccgcattggaagaaaaggctgccgcaacatctcagcgaggagtgaaggacccatgtcccaggaaccgcgctgcgccacctgcactcacccccctcacattctcttaagcacccggtggccctccgaggctggcggaatggtggtgcccacggggttgggcaagggctcaccaggacctcaacgggcaaagttgtgcacactaaaatatcaaatcaaggtgcttggttttaaagtaaatgtttttctaaagaaagctgtgttcttctgttgacccagacgaatagggcacagccctgtaactgcacgtgccttctgtcattgggaatgaaataaattattacgagaaagggacttgtcctaactggtttgaggccttacagttttgtatctacatttttcccctcctggggtttgcggggacagggacagaactacaggagtcatgggaaagaaaattctggcttcactactgctcactgctcactttctgatcactctgatactttttttttttttttttttttgcaacctgataccttgaaaagcttctatgtgtctctccttttgttgcctggcagctgtctaggatgatcactgattactatttactaagtagccacatgcaaataaaagttgtttggtaaaatggaaaaaaaaaaa

SEQ ID NO: 1876 - DNA, 1009 bp, Homo sapiens
tcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcacttgtgggagccgcatatcacccaacgccaggtggagaaagcctgggccctcttgcagaagcgcattcccaagactcatcaggccctcgactgaaaggttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctg

SEQ ID NO: 1877 - DNA, 3288 bp, Homo sapiens
cttcctctccacgcggttgagaagaccggtcggcctgggcaacctgcgctgaagatgccgggaaaactccgtagtgacgctggtttggaatcagacaccgcaatgaaaaaaggggagacactgcgaaagcaaatcgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttatagatgatatataaaagtacattttaatagaagccagggtttaaggaatttcacatgtataaggtggctccatagctttatttgtaagtaggctggataaatggtgcttaaatggtaatgtactccacttcttcccattggaagattaacattatttaccaagaaggacttaagggagtagggggcgcagattagcattgctcaagagtatgga

SEQ ID NO: 1878 - DNA, 1496 bp, Homo sapiens
gcacgaggcctgcactttgtcaagtttgccatcgacagtgaccagctccatcagctctgggagaaggaccagctcaacatggccaagaacacctggcccattctgaagggctttcaggaggggcccctcaacttcgctcccaccttcaagtttgatgtgggtaccaacaaatacgataccagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgggtttccgccattgcaaggactatgtggcttatgtctgggccaaacatgaagatgtggatgggaatacctaccaggtaacattcagtgaggaatcactgcccaagggccatggagacttcatcctgggctactatagtcacaaccacagcatcctcatcggcatcactgaacccttccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctcaaaaaaaaaaaaaaaaaaaaaaaaa

SEQ ID NO: 1879 - DNA, 1418 bp, Homo sapiens
agaagaagctggccaaggatatgggagcaaccaccatggaccagaagtctctctgggcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcgcctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccttgtgaaggattaacttacagagaagcaggcaagatgaccttgctgcctggggcctgctctctcccaggaattctcatgtgggattccccttgccaggctggcctttggatctctcttccaagcctttcctgacttcctcttagatcatagattggacctggttttgttttcctgcagctgttgacttgttgccctgaagtacaataaaaaaaattcattttgctccagta

SEQ ID NO: 1880 - DNA, 4858 bp, Homo sapiens
ggaattcttttttttttttttttttttgaaacagggtctcgctctgtcacccaggctaaagtgtagtgccgcgatctcagctcattacaacctctgcctcccaggttcaagggatcctcccacctcagcctcccaagcagttgggaccacaggcatgtgccaccatatccggctaatttttgcttttttcatagagacagggtttcaccatgttgcacaagtcggtcttgaactcctgagctcaagtgagctacctgctttggcctcccaaagtgctgggattacacatgtgaaccaccgtacccggccccaaaaatgctttcttaagcgtaactacgtaatgctagttgtagtttagattcctggatgttaacttaaaatagtcccataggaacccagtgtggtggctcacgcctgtaatcccagcctgaggcaggtggatcatctgaggtcaggagttcgagaccagctgggccaacatggtgaaaccctgtctctactaaaaacacaaaaaaattagctgggcatagtggcaggcacccgtaatttcagcttctcgggacgctgaggcagaagaattgcttgaacccaggaggcagtggttgcagtgagcccagatcgtgccattgcactccagcctgggcaacaagagcaaaactctgtctcaaaaaaatcaattaatttaggctgggcgcagtggctcatgcctgtaaatcccagcactttgagaggctgaagcgggtggatcatgaggtcaagagatcgagaccatcctggctaacacggtgaaaccccatttctactaaaaatacaaaaaaaaaaccccaaaaaacaaaaaaacaaaaacaaacaaacaaaccaaaaaaacacaacaactagccaggcgtagtggcaggcgcttgtaatcccagctagtcgggaggctgaggcaggaggagaatggagtgaacccaggaggcagagcttgcagtgagctgagatcgcgccacagcactccagcctgggcaacagagcgagactccatctcaggaaaaaaaaaattaattaattaaaaaaacagtaagataaataacacttctcccatttcagtaaaaggatgaagccagtttctcaatgaataaaaacaagagactgttgaatgtcaagttttatagacagtccagacaacacagggagacaccatctctacacacacacacacacacacacacacacacacacacacacacacacacacacacacaaaatagctgcgtatggtggcatgggcctgtagtcccagctattggggcagggccagggggtgggaggctgaggggagaggatgccttaacagggaggttgaggctgcagagagccatgatcacgtcactgtactccagcctgggtgatacagcaagactctgtctcagaaaaaaaaaaaagaaaaaagtcaagaatgcattcttgaggaattccaccaacaaaatgcaccaaatatagccaaagagttttctgctatatgccaagtggaaagctatgaagaaagagaagaacagaagcaggaggacattggttttcatctcctattctttcaagaagtaagatccattatcttttaaaaagtctaaacactggtaaggcaagacacaactcccacccataacactgcatctctgtcctcaggcaacaaatcaaatgtcagataaaagcacaatatctaccactcaacccccaggcttcagcacagaactcacaaacattctgctggctaaggcaaaaaggtgtactgtatttccagagagcttgcagagttctgagcactaatcccataatcctcatatctcaatctacacaaagcaccatcaggctaagaaacagattatatagcaggcacaacactcttgggtatgcaaacatgttaaggatcaaagtaagaaaagagtaactataggggccatactatatttgccaaaaagtgacttgtttaaaaattaaaaagaagccgggtgcagtggctcacacctgtaatcccagcactttgagaggctggggtgggtggatcacctgaggtcagtagttcaaaaccagcctggccaacatagtgaaaccccatctctactaaaaatacaaaattaggcgtggtggcaggcgcctgtaatcccagctactagggatgctgaggcaggagaatcgcttgaacccggaaggcagaggttgcagtgagccaaaatcgcaccactgcactccagcctgggcaacaagagcaaaactctgtctcaaaaaaaaaaaaataaaaataaaaacaaaaaagaaatccagtttacctccttgtgcaattcctaataaattgctgagaagtgatcttacataggaatcttgtataatttattctgatgcgttcgaggtggccgttagttgactccgcggagttcatctccctggttttcccgtcctaacgtcgctcgcctttcagtcaggatgtctgcccgtggcccggctatcggcatcgacctgggcaccacctattcgtgcgtcggggtcttccaacatggcaaggtggagatcatcgccaacgaccagggcaatcgcaccacccccagctacgtggccttcacggacaccgagcgcctcatcggcgacgccgccaagaaccaggtggccatgaaccccaccaacaccatcttcgacgccaagaggctgattggacggaaattcgaggatgccacagtgcagtcggatatgaaacactggccgttccgggtggtgagcgagggaggcaagcccaaagtgcaagtagagtacaagggggagaccaagaccttcttcccagaggagatatcctccatggtcctcacgaagatgaaggagatcgcggaagcctacctggggggcaaggtgcacagcgcggtcataacggtcccggcctatttcaacgactcgcagcgccaggccaccaaggacgcaggcaccatcacggggctcaatgtgctgcgcatcatcaacgagcccacggcggcggccatcgcctacggcctggacaagaagggctgcgcgggcggcgagaagaacgtgctcatctttgacctgggcggtggcactttcgacgtgtccatcctgaccatcgaggatggcatcttcgaggtgaagtccacggccggcgacacccacctgggcggtgaggacttcgacaaccgcatggtgagccacctggcggaggagttcaagcgcaagcacaagaaggacattgggcccaacaagcgcgccgtgaggcggtcgcgcaccgcttgcgagcgcgccaagcgcaccctgagctcgtccacgcaggcgagcatcgagatcgactcgctctacgagggcgtggacttctatacgtccatcacgcgcgcccgcttcgaggagctcaatgccgacctctttcgcgggaccctggagccggtggagaaggcgctgcgcgacgccaagctggacaagggccagatccaggagatcgtgctggtgggcggctccactcgtatccccaagatccagaagctgctgcaggatttcttcaacggcaaggagctgaacaagagcatcaaccccgacgaggcggtggcctatggcgccgcggtgcaggcggccatcctcatcggcgacaaatcagagaatgtgcaggacctgctgctactcgacgtgaccccgttgtcgctgggcatcgagacagctggcggtgtcatgaccccactcatcaagaggaacaccacgatccccaccaagcagacgcagaccttcaccacctactcggacaaccagagcagcgtactggtgcaggtatacgagggcgaacgggccatgaccaaggacaataacctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaacaagatcctcgacaagtgtcaggaggtgatcaactggctcgaccgaaaccagatggcagagaaagatgagtatgaacacaagcagaaagagctcgaaagagtttgcaaccccatcatcagcaaactttaccaaggtggtcctggcggcggcagcggcggcggcggttcaggagcctccgggggacccaccatcgaagaagtggactaagcttgcactcaagtcagcgtaaacctctttgcctttctctctctctctttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagcttaaattgtttatttttatgtactactttaaaactaaactgaacattgcagtaatgttaaggacaggtatactttttgcaaacaaatgcataaaatgcaaatgtaaagtaaagctgaaattgatctcaaaaaaaaaaaa

SEQ ID NO: 1881 - DNA, 1203 bp, Homo sapiens
gaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggcc

SEQ ID NO: 1882 - DNA, 4053 bp, Homo sapiens
gaattcgcggccgcgtcgaccaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagcagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtgacccaatgttgtcttccagttgtgaaagcaccccagagacccactatccaagtttcactctagcgtggaggcagggcaggcagccctgatcaaatatctcctacacaattcgtttacttcgtttgaatgttagagccacttgtgattatttttttgtgtttctaacttacagtttaaatttatttgtaaaaagttaaaggatagtgggtctttgtgtggctttccctgctgttcactctggcatctttagcatttttcttcttttttaatttgataattgtaggtcattagcatgcatattgagtttgcccttatgtggtgggagttcaaacacacaaagacccactatttgcacaaactattcttactggtttggaataggctgccatgcttttttaatgttattgcaacatgtgtattcatttacagaattcagataaaatttgcttatgttctgctattatgtttgatctaatcctaatcacagtgagctcttaattagctcaatatgtggtttgccctcaagtgtgcactgtttattactttgtaatatgccactatgagtactgacatttagatatgtttaaaggccaaaaactggaaacagccatgccctgttttctgtgtatttgggatgggaataacaacattttgggggagctttttaaatctcagagaaaaggaaagtggcctgctctggcaggtatgtgcagtgtttcatttgttccagtcccaaaaatgagcactgtcctatggtagttcgcttaggatctttatgtgctctgggctaatgaaggtactgcatcatgtgctgcagcgtgtgtattctttttcgatgacctataaagggattatttttgaggaatgaaaggctcccatcattgactgtgagatgggaaaaacctttcctagcttagagcatttatatcttaatccattttaaagtcagagttcattgttacctgttttaatcaggtgactacatgtcccagtatacaaaggggcactggttgacattcttcttaatgtatttagtaaatatcataagaaatcctttaagagtttaaatgtccccaaaacagacatgcgggctctagtcaagaatgaattagagtgaaggaaagctgtgtaacacctggcattcctctgtgttcatggagcttctttgaggctctaagattgattttaccatcagacttctctaatacctgttcttcaaccatattggctactttgacataagaatttacttcttttcctggaatggaaaacactttaaaaaataataacaaacattattataaactaatatatgtgagagtacttagttgatacaaaaaggagttttagtagacagtattatactatatttgaaaatcaaggagaattttatgcaacttaaaatgtttacaaactgcagtgcaatctactgtttgtgaatgtcaaagtatcaggaaaagtgtatatacaatcacagagtcatatttcctcacaaagttatttacaaagagtgaaatatgtttttgtacctctcagtttcagttagaggcatattttgtgcaatatttatgttaatgtgcctatacattatgaatgaattatttcagtcatacattgcctaaatcataactttatgatgcttgggaaagaatcaacagttaaaacttcataaagttctaatgtctgtgttccaaaatacatcacattattaggatgtagggagataagtatgtgtgctccctagggtggcaatttctagttactagaccacctctatttttagcatttggcatcctcatgatacttttataaatatgacattaataggaaagcaataatttcattttacagatagaataacagatttgcctgcattcactgaaagagtgcaaagactgggtccttgtgaattcaactgactctcccaaattgtattaattacctgttcttgccttttattttctgaacttgctgcttttgcattcttttgagttcaaagacagttactttaaatccatttttaaaccctcggggtagaaatcataccactgttaatcagccacattatttggtctaaggttttttctttataattctgaaactgagtttatctaatacattgatgaattatttcaaacgtatttttatagttcaaatcagttcacttttacactgataaatataaattactaggaatgaccttcagacagcgtttagcatctgtaaccaacctgaaaataatatgttcatcaggtacctatggattaaatcatatactggcgtatttaagctgaatgtcagtctggaaaataaatttactatattaactgaaataccactctttgtgtaggtattttgtcatgtatttaagaaaaagataaaaagaatggaaatcatatgacataataacttaagtctttcttaaaagtgcatgctgtcttttgcaatacctcattcagccaagtatttgttctcttcctcattcagtataagtcagctttcaatttgcttagaaggcaacattagaaggttagagttcatcagaaacatagaattttaaaatgtgagttcaactgaataaatttgaatttctgtaggaggtaaagaatcaaaatacctgtttaaagattgcaattgcaatgtataataatcacttttaaattatttgattaaaccttttaggttttccagaaatgaaaaaaatcagttctaaaaccaaagctgatttttagaaaatttgagaatgtaaatcagccctatccataatatagtttctctaaaactttatcttaaagagtcattttaaaataatataactattaaaaatgtaactgatatttaaatgttttgaaataaaacattttaaaatataaatactgtagtttaaaagaaagaaactgggggaaagaaaagtagagaaagaaataccaattccagtccaaagctttatttgccagttttcttagaatgacttttaccagtttatgaattcttgtaaacagaatctataatggaaatactgaaagacttttgcctaaagtggcattattgaatgctgctgtgatgctactgtaatgtaataaattattaaattgttgcaaagtgctgtttttgccttaaaattttattttgtgtgtcttgaaaattatagtattaaaggtattgagattgtgcaaatgctgggcacgcttggcatgagataatctgtttttatttttaccaaattgtaatataactatgcaagtgtgtttattaaaagaacaccaactataaaaaaaagtcgacgcggccgcgaattccagctgac

SEQ ID NO: 1883 - DNA, 1327 bp, Homo sapiens
gtacgttcctcatgaaagggacgacgggagctgcatgaaagccgaagttatggaccgctagcatctgtcactggccaccggtttccgggagtaagcggcagctaccttacagccctgacacgagccgggtgctctctcttctcaccgcggcccacgtctcctcgctggctccggtggcctcgctgggtcgcgaggaggcggaggactgtactctgaggccaaaagccagagtcggccctgaacgcccacgactctcagggtccagaggccgtgagaccggccgcggctgaaaggtaaagaaaccaagtggaagagtgtttcctcctctggccgtaaagcagctgtccccgccctactccggaccgccccaaagactccatgggatggacctgagtcagccgaatcctagccccttcccttgggcctgctgtggtgctcgacatcagtgacagacggaagcagcagaccatcaaggctacgggaggcccggggcgcttgcgaagatgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatggcaccttcaatttgccatcgtgacgcagacctgtataaattaggttaaagatgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatga

SEQ ID NO: 1884 - DNA, 1716 bp, Homo sapiens
gccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcagcagcattttcttcctcacgtgcatgagcgtggaccgctacctctccatcacctacttcaccaacacccccagcagcaggaagaagatggtacgccgtgtcgtctgcatcctggtgtggctgctggccttctgcgtgtctctgcctgacacctactacctgaagaccgtcacgtctgcgtccaacaatgagacctactgccggtccttctaccccgagcacagcatcaaggagtggctgatcggcatggagctggtctccgttgtcttgggctttgccgttcccttctccattatcgctgtcttctacttcctgctggccagagccatctcggcgtccagtgaccaggagaagcacagcagccggaagatcatcttctcctacgtggtggtcttccttgtctgctggttgccctaccacgtggcggtgctgctggacatcttctccatcctgcactacatccctttcacctgccggctggagcacgccctcttcacggccctgcatgtcacacagtgcctgtcgctggtgcactgctgcgtcaaccctgtcctctacagcttcatcaatcgcaactacaggtacgagctgatgaaggccttcatcttcaagtactcggccaaaacagggctcaccaagctcatcgatgcctccagagtctcagagacggagtactctgccttggagcagagcaccaaatgatctgccctggagaggctctgggacgggtttacttgtttttgaacagggtgatgggccctatggttttctagagcaaagcaaagtagcttcgggtcttgatgcttgagtagagtgaagaggggagcacgtgccccctgcatccattytctctttctcttgatgacgcagctgtcatttggctgtgcgtgctgacagttttgcaacaggcagagctgtgtcgcacagcagtgctgtgcgtcagagccagctgaggacaggcttgcctggacttctgtaagataggattttctgtgtttcctgaattttttatatggtgatttgtatttaaattttaagactttattttctcactattggtgtaccttataaatgtatttgaaagttaaatatattttaaatattgtttgggaggcatagtgctgacatatattcagagtgttgtagttttaaggttagcgtgactttcagttttgactaaggatgacactaattgttagctgttttgaaattatatatatataaatatataaatatatgccagtcttggctgaaatgttttatttaccatagttttatatctgtgtggtgttttgtaccggcacgggatatggaacgaaaactgctttgtaatgcagtttgtgacattaatagtattgtaaagttacattttaaaataaacaaaaaactgttctggactgcaaatctgcacacacaacgaacagttgcatttcagagagttctctcaatttgtaagttatttttttttaataaagatttttgtttcctaaaaaaaaaaaaaaaaaaaaa

SEQ ID NO: 1885 - DNA, 1668 bp, Homo sapiens
gcggccgcccatcgacctggtcatcgaggatcgggatggcggctgcagggaggacttcgaggactacccagcctcctgccccagcctcccagaccagaataatatatggattcgagaccatgaggatagcgggtctgtacatttggggaccccaggtccatccagcggggggctggcctcccagagtggggacaactccagtgaccaaggagtcgggctggacaccagcgtggcctctcccagttctggtggagaagatgaggacttggaccaggagccacggcgaaacaagaagagggggatcttccccaaggtggccaccaacatcatgcgagcctggttgttccagcacctctcacacccgtacccctcggaggagcagaagaaacagctggcgcaggacacggggcttaccatcctgcaagtcaacaactggttcattaatgcccggagacgcatcgtgcaacctatgatcgatcaatccaaccgcacagggcagggtgcagccttcagcccagagggccagcccatcgggggctataccgagacagagccacacgtggccttccgggctccagcatcagtgggggatgagtttggaactcggaaggaggaatggcattatctatagaggctgatgcgggagagacccagcctccggctgtgacccccagcctcacacctggctctggttcccgcctggtcctctggcttcaggatcccacctccaaaggcctctccgctcaacgcctacctccctagggccctgctgggacatgggggcctgagtgcccacccaaggggctctcaaggacaccggcaaggcctccaggctctgagccccgcttctgccttcacctctgcctgggacccgagctgggctcctgggccttggtccccagaagatggcagctagggcctcgccgcgaggacagagaagggacagggtggctgggcagtcagggaaggagggtcgcccggatccgacattttggagagattctttcaccctcctgtcccccccacctcccttctctaatttcttctttttttaatgataaagtcttaaaacacagaaaaaaaaaagacttcagagaattaggtagatgaagcactttatacagtatatatcttcagcttaaatttgttttgagtattttttttatttttaagtaggcaaagatttaaaattttttatttttagtaaatgtttgaagcaaactaaaaagacgtgggcaatatttaccacaaccaaacagaacccacaaaattgtacatcttgatcttagcaaatatccttattgtagagacacttaataaagagatggtattttaatatctccagttctgaggtagggtgtaacttagttctacattgtgatttaggaatttttaaacctttcttcttcaggggagaagtgacccaggcctcgagtttagtgctaaagccactagtgtacttatgctgtcacctaaccaccacatgcgacatggaggcagaggctaaatataggggctttcttaagaaagtgagaggaaattagcaagcattattagtgtttgactactgctatcaagtgaattcaaaggaaacaggtttttatgtcatatttaagttacagaaaccaggcatgcttagaatagtttctaaggtgacagagcggccgc

SEQ ID NO: 1886 - DNA, 1843 bp, Homo sapiens
ggcacgagcaagacatcaactgaatgaggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaatgagggaaatactctgaattattaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatctaaaaaaaa

SEQ ID NO: 1887 - DNA, 3492 bp, Homo sapiens
ggttggaggagcccggagcccgccttcggagctacggcctaacggcggcggcgactgcagtctggagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtttttggggaacaggtggtgtttggttacatgagtaagttctttagtggcgatctgcgagattttggtacacccatcaccagcttgtttaattttatctttctttgtttatcagtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggacaaaaaaaaaaaaaaaaaa

SEQ ID NO: 1888 - DNA, 4203 bp, Homo sapiens
ttcactgaggggacccgccagtttcaaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgcgtggacatgcagagaagcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacattgaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtgttttcggcccctccctggctcttaccaggtcacgtgatccctccagacaacatcctgccccttgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcatagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagcgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgyctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgccccacagccctgcctggatttgtatccttggcttcgtgccagttcctccaagtctatggcacctccctccctctcaaccacttgagcaaactccaagacaccttctaccccaacaccagcaattatgccaagggccattaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctacaggtccttaaataaaagtgtgctgttggttaaaaaaaaaaaaaaaaaaaaa

SEQ ID NO: 1889 - DNA, 1792 bp, Homo sapiens
tgcagatgccctgtgccgtgcagctcagcatgcataggtggggtagttggttgatgagcttttctttaggagaacagattttgagctatctttttttgttggaaccctgcacacaactgtcattatgtagatggttttcctctcaggtggttggttttctccagagaagaacccttgaatctcctgcctgtggaggtggacgtgtggttggtgttctgggtgccccttgccctgagctctgttctccatggtgcctgtttcctgggtctgcagccccttctcagtttctctgaagagtaaacctctcccctgcttggggaggagcatgggggttacgtagtagcctggctgcataacatgggcttagtagctcagttttccatcatgaaccagagcctcatctttcatggttcctgtgcctccgagggctgggctactggggtgtctgtcagtccagatggctttgttctcaagtttcctccacagtggatatgaatgtttgcaacttacactcaattacaacgctttcctctacttttctccaagtttgctgaaatctttatttgtggatatctcctctctttttgctttgtcctcataggttaaaacgttttaaaattccctaacagtaggaaatttagtagggttttggaagggagaggaggtgtaagatggtcactcttccatgtttaactggaagtggaaagtctaggcttttgcttcaggcctgggaggtgcacatgaaacagtccctcccagtggctgcctggggggtccctgaagggtgtgagaccaccgtgaatcctggggcagggcacttgcagtacatgtgctatgtgtttgctagtattgttttagatgtttgatctcctagcctttgcttttctttgtatttttcctgctttagtccatttcccttctagctccttctgttctcatttatcttctgctgctgcttggagttacattttcagcaagtctgtaacacctctctgaaccaaaggctctcaagttcatctttctttctccaagcctacgcctgtgctgctgtcatgagtggcgagcttctgtttcttctgtcttcttgtcagtcccaagtgcccttttacagagaatgcctgtttttcactgtctagctcagttaccaggagtccctgtgaatgacacccacaggtccctcaaagaagtcagatttctcttggacctgataaagcaaacaaaatgtgacccaagcaggctgagttggacgggtcccttcttaccttcgccctctgccatgttgacattcttatctgatggcacaggctgggagttcaggatccacttagatggggtccgttcaggggataccagcgttcacatttttccttttaagaaagggtcttggcctgaatgttccccatccggacacaggctgcatgtctctgtgagtgtcaaagctgccatgaccatctcggtaacctactcttactccacaatgtctatattcactgcagggctctatgattagtccataatgtaaatgcctggcccaagacgtatggcctgagtttatccaaggcccaaacaattaccaaacattcctcttagatagaagacagatttctttcccttggcaaagatcttctactaagatatgttacaggatgttttacattctcttggtcttataataacaccacgcccaatccagtatttgatgcgtcggtggtcactcggaaggttgttattttaaaaatacttattgttctcagtctgcagttctcacagctgtaaaaaaaaaaaaaaaaaa

SEQ ID NO: 1890 - DNA, 2224 bp, Homo sapiens
aaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtatataaaaggaaaacagaagctgccaaaaaagaatacctgaaggccctggcagcatacagagccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccccgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaaatgcaagtgactaaattcaattattgactaatttccactttttatccatgacttctccaaatcaaaccacagtatatgttgtaacaaatatctatgaccactgttagcccattatattcattccaattagaagaaaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgttgcaacaacaaagaaactgttcacttttcaaataaaatgatatgtcagggaattc

SEQ ID NO: 1891 - DNA, 1639 bp, Homo sapiens
ccgccccctccggcgtgttcatgcccccggggccccagggagcgccatggcccgcgcacgccaggagggcagctccccggagcccgtagagggcctggcccgcgacggcccgcgccccttcccgctcggccgcctggtgccctcggcagtgtcctgcggcctctgcgagcccggcctggctgccgcccccgccgcccccaccctgctgcccgctgcctacctctgcgcccccaccgccccacccgccgtcaccgccgccctggggggttcccgctggcctgggggtccccgcagccggccccgaggcccgcgcccggacggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgactgagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactggggggggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtggaaaaaaaggccttcgtggcctcgagagatc

SEQ ID NO: 1892 - DNA, 6817 bp, Homo sapiens
cagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggcccaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagacacaatgacacttagaggaagtgtccaaaataaactcaatccccgacctggaaaggtagtgatatatagtgaacccgacgtctctgagaagtgcattgaagttttcagtgacattcaggattgcagttcttggagcctctctccagtgatactcataaaagttgttagaggatgttggattttgtatgagcaaccaaattttgaagggcactccatccccttagaagaaggagaattggaactctctggtctctggggtatagaagacattttggaaaggcacgaagaagcagagtctgataagccagtggtgattggttccatcagacatgtggttcaggattacagagttagtcacattgacttatttactgaaccagaagggttaggaatcctaagttcctactttgatgatactgaagaaatgcagggatttggtgtaatgcagaagacttgttccatgaaagtacattggggcacgtggctgatttatgaagaacctggatttcagggtgttcctttcatcctggaacctggtgaataccctgacttgtccttctgggatacagaagcagcgtacattggatccatgcggcctctgaaaatgggtggccgtaaagttgaattccctacagatccaaaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatttgggttgcatatgagaagcctggatttaccggtcatcagtatttgctagaagaaggagaatacagggactggaaagcctggggaggttacaatggagagcttcagtctttacgacctatattaggtgatttttcaaatgctcacatgataatgtacagtgaaaaaaactttggatccaaaggttccagtattgatgtattgggaattgttgctaatttaaaggagactggatatggagtgaagacacagtctattaatgtactgagtggagtatgggtagcctatgaaaatcctgacttcacaggagaacagtatatactggataaaggattttataccagttttgaggactggggaggcaaaaattataagatctcttctgttcaacctatatgtttggattctttcactggcccaaggagacgaaatcagattcacttgttttcagaaccacagtttcaaggtcacagtcaaagttttgaagaaacaacaagtcaaattgatgattcattttctaccaagtcttgcagagtttcaggaggcagctgggttgtatatgatggagaaaatttcactggtaatcaatacgtgttggaagaaggccattatccttgtctgtctgcaatgggatgcccgcctggagcaactttcaagtctcttcgttttatagatgttgaattttctgaaccaacaattattctctttgaaagagaagacttcaaaggaaaaaagattgaacttaatgcagaaactgtcaatctccgatccctgggattcaacacacaaatacgctctgttcaggttattggtggcatatgggttacttatgaatatggcagttacagagggcgacagttcctattgtcacctgcagaagtacctaattggtatgaattcagtggctgtcgccaaataggttctctacgaccttttgttcagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcaggatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatatgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactaaaaaaaaaaaaaaaaaaaaa

SEQ ID NO: 1893 - DNA, 2402 bp, Homo sapiens; identical to SEQ ID NO: 1864

SEQ ID NO: 1894 - DNA, 1896 bp, Homo sapiens
gtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccagataactgtcttcactgtgaccagtcggagtccctgcttgcttgtgaagaaggggcttttgtaccttgttggagatgccacctcagaagttcacactgtgcaggaaaaaggttttattctctcctggcatacattagaatgtcagatgcctgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaaggcctattctactcttatttaaagtgaaacactgtatacttgtttctctccaaagcgaaattaagtatttataatttcaattgcctcgataagtttccaagtcactgaaatctgctgaaggttttactgtattgttgcacaactttaagataatttttgtctcaatgtcaacttttttcactgaataaaaatttaactgggtcaagaaaaaaaaaaaaaaaaaaaaaaaaaaaa

SEQ ID NO: 1895 - DNA, 2064 bp, Homo sapiens
agaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagacctcagaggctcgggaggcacctgccacccaggcctcgtctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacgaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtgaagcatctggatggggaagaggatggcagcagtgatcagagtcaggcttctggaaccacaggtggccgaagggtctcaaaggctctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggcaaatgatttggtgaagtaccttttggctaaagaccagacgaagattcccatcaagcgctcggacatgctgaaggacatcatcaaagaatacactgatgtgtaccccgaaatcattgaacgagcaggctattctttggagaaggtatttgggattcaattgaaggaaattgataagaatgaccacttgtacattcttctcagcaccttagagcccactgatgcaggcatactgggaacgactaaggactcacccaagctgggtctgctcatggtgcttcttagcatcatcttcatgaatggaaatcggtccagtgaggctgtcatctgggaggtgctgcgcaagttggggctgcgccctgggatacatcattcactctttggggacgtgaagaagctcatcactgatgagtttgtgaagcagaagtacctggactatgccagagtccccaatagcaatccccctgaatatgagttcttctggggcctgcgctcttactatgagaccagcaagatgaaagtcctcaagtttgcctgcaaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttagatattgttaatcctgccagtctttctcttcaagccagggtgcatcctcagaaacctactcaacacagcactctaggcagccactatcaatcaattgaagttgacactctgcattaaatctatttgccatttcaaaaaaaaaaaaaaaaaaaaaaaaaaaaaaaaaaaaa

SEQ ID NO: 1896 - DNA, 2203 bp, Homo sapiens
cggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgaggtggagagtctcacagccgcccgaaatgcctgcagggcgggcaccgagccatcagatgccatccgcgtggtcaatgctgtcttgacccaaattgatcagattaaaaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaagtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcaagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctgccgaatgttatgttttgcttttatctcacagtaaaataaatataattaaaaa

SEQ ID NO: 1897 - DNA, 335 bp, Homo sapiens
cagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagattgagtggttttatgtggtattcggcggagggaccaagctgaccgtccta

SEQ ID NO: 1898 - DNA, 607 bp, Homo sapiens
tttttttcatttttgcaacaggcttttattacttttttttaaaacccatataagaaagacatttaaaaagaaaatatcctggaaacaaacacttacacactgagcaacacaaccaaagaaggcactaccagcagttactcccacctctgggagggaacaggtactcgatactatacttttttcagaggtttagacctcagcataggccttgggtctaactgtgctttagtaaagtctgaattgtccaataattttctcatttcataaacacccttatctctttatatatagctatatgcctttatgtgtatatatacatgactttttttttccttctcaaaaataaaatagccatccccatagagggaggttctcagcagcattcacagcggttgcagcaggagccatgccttctattaatgttagagacatgcaggacgaggaaaatgactctccacctgctccctttaatatacagcagggagagagttctaaagggagggaagtgataaggtgagcatgagatggtaaccagggttttgtggttaaaaaatctagagtgcgagctgtgtgccttgaaccctggagctatgccagtcatcgcgag

SEQ ID NO: 1899 - DNA, 1151 bp, Homo sapiens
ctggtctagaatattccacatctgctctcactctgccatggactcctggaccttctgctgtgtgtccctttgcatcctggtagcgaagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttctcgacctgttcggctaactatggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctgaaggcagccctggaagtggagttaggagcttctaacccgtcatggttcaatacacattcttcttttgccagcgcttctgaagagctgctctcacctctctgcatcccaatagatatccccctatgtgcatgcacacctgcacactcacggctgaaatctccctaacccagggggac

SEQ ID NO: 1900 - DNA, 1304 bp, Homo sapiens
ttcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatgtcccaccctgtacctcatcccatgagacctggtgcctggctctttcgtcacccttgtacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttggacccataatcctttctgccgacccctagttccctctgctcagccaagcttgttatcagctttcagggccatggttcacattagaataaaaggtagtaattag

SEQ ID NO: 1901 - DNA, 1643 bp, Homo sapiens
gcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaattgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgctt

SEQ ID NO: 1902 - DNA, 935 bp, Homo sapiens
ccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccagccaatggacacagtagggcttggtgaatgctgctgagtgaatgagtaaataaactcttcaaggccaaggaacagtggtctaattcaactctgtgtcccagcactggcacaccagaagtgccatgctcagaaatgttggttacatgaatgaatgaaccatgaatgaatg

SEQ ID NO: 1903 - DNA, 2212 bp, Homo sapiens
ggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccatccaaccagggacagtgggtccccaggggaggcgaggcccccctggggcaccgggggagatcgggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaaccaaaaattggttttatttttttcttaaaaaaaaaaaaaagtctaccaaaggaatttgcatccagcagcagcacttagacctgccagccactgtcaccgagcgggtgcaagcactcggggtccctggaggcaagccctgcccacagaaagccaggagcagccctggcccccatcagccctgctacgacgcaccgcctgaaggcacagctaaccacttcgcacacacccatgtaaccactgcactttccaatgccacagacaactcacattgttcaactccttctcggggtgggacagacgagacaacagcacacaggcagccagccgtggccagaggctcgaggggctcaggggctcaggcacccgtccccacacgagggccccgtgggtggcctggccctgctttctacgccaatgttatgccagctccatgttctcccaaataccgttgatgtgaattattttaaaggcaaaactgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccaccttgtccctgagatttaacccctccactgctgggggtgagctgtactcttctgactgccccctcctgtgtaacgactacaaaataaaacttggttctgaatattttt

SEQ ID NO: 1904 - DNA, 1597 bp, Homo sapiens
aacaaactgcacccactgaactccgcagctagcatccaaatcagcccttgagatttgaggccttggagactcaggagttttgagagcaaaatgacaacacccagaaattcagtaaatgggactttcctggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcagcaaccagggagactgcacctgatggaaaagatatatgactgcttcatgacattcctaaactatcttttttttattccacatctacgtttttggtggagtcccttttgcatcattgttttaaggatgataaaaaaaaaataacaactagggacaatacagaacccattccatttatctttctacagggctgacattgtggcacattcttagagttaccacaccccatgagggaagctctaaatagccaacacccatctgttttttgtaaaaacagcatagctt

SEQ ID NO: 1905 - DNA, 1026 bp, Homo sapiens; identical to SEQ ID NO: 509

SEQ ID NO: 1906 - DNA, 1321 bp, Homo sapiens
gacagatttcactgctcccaccagcttggagacaacatgtggttcttgacaactctgctcctttgggttccagttgatgggcaagtggacaccacaaaggcagtgatctctttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaacttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaaaaaaaaaa

SEQ ID NO: 1907 - DNA, 1433 bp, Homo sapiens; identical to SEQ ID NO: 502

SEQ ID NO: 1908 - DNA, 3020 bp, Homo sapiens
gttcaaggcagcgcccacacccgggggctctccgcaacccgaccgcctgtccgctcccccacttcccgccctccctcccacctactcattcacccacccacccacccagagccgggacggcagcccaggcgcccgggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagcctcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtctggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaagaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggactgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaaaaaaaaaaaaaaa

SEQ ID NO: 1909 - DNA, 1224 bp, Homo sapiens; identical to SEQ ID NO: 1859

SEQ ID NO: 1910 - DNA, 2019 bp, Homo sapiens
acgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattgggataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaatccttcggattaaacatggaagttatgaagatgctgttcactctggagcccttaatgattgatctgatgttccttttatttataacaatgttaaatgcaatgtcttgtaccttgagttgagtattacacattaaagtaaagtacaagctgtaaacttgggtttttgtgatgtaggaaatggtttccatctgtactttggtcctctgatttcagatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattc

SEQ ID NO: 1911 - DNA, 3212 bp, Homo sapiens
gaattcccgctcggcccgcgacctgccccgagccctctccatggaggcagcccgcccctccggctcctggaacggagccctctgccggctgctcctgctgaccctcgcgatcttaatatttgccagtgatgcctgcaaaaatgtgacattacatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtcctaaagaaaagacatactaaagaaaaagttctaaggcgcgccaagagaagatgggctccaattccttgttcgatgctagaaaactccttgggtccttttccacttttccttcaacaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgagataattgcctttgcaacaactccagatgggtatactccagaacttccactgcccctaataatcaaaatagaggatgaaaatgataactacccaatttttacagaagaaacttatacttttacaatttttgaaaattgcagagtgggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagagttaattgacaagtaccagttgaaaataaaagtacaagacatggatggtcagtattttggtctacagacaacttcaacttgtatcattaacattgatgatgtaaatgaccacttgccaacatttactcgtacttcttatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaagaatccattagaggacacactctgattaaaaattaaacaatgaaagaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgggaattc

SEQ ID NO: 1912 - DNA, 915 bp, Homo sapiens
ctgatttgcatggatggactctccccctctcagagtatgaagagagggagagatctgggggaagctcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagccgctccaacgtcggaagtaataatgttaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcaacatgggatgacagtactgtggtcttcggcggagggaccaagctgaccgtccctggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgc

SEQ ID NO: 1913 - DNA, 819 bp, Homo sapiens
ggccagcttccctctcctcctcaccctcctcactcactgtgcagggtcctgggcccagtctgtgctgactcagccaccctcagcgtctgggacccccgggcagagggtcatcatctcttgttctggaagcagctccaacatcggaggtaatactgtaaactggtaccagcagctcccaggaagggcccccaaactcctcatccatagtaataatcagcggccctcaggggtccctgaccgattctctggctccaagtctggcacctcagcctccctggccatcagtgggctccagtctgaggatgaggctgattattactgtgcagcatgggatgacagcctgaatggtcggtatgtcttcggaactgggaccaaggtcaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaacc

SEQ ID NO: 1914 - DNA, 2325 bp, Homo sapiens
ttttttaaagtaagatgtttaagaaattaaacagtcttagggagagtttatgactgtattcaaaaagttttttaaattagcttgttatcccttcatgtgataactaatctcaaatactttttcgatacctcagagcattattttcataatgagctgtgttcacaatctttttaggttaactcgttttctctttgtcattaaggagaaacactttgatattctgatagagtggccttcattttagtatttttcaagaccacttttcaactactcactttaggataagttttaggtaaaatgtgcatcattatcctgaattatttcagttaagcatgttagttggtggcataagagaaaactcaatcagatagtgctgagacaggactgtggagacaccttagaaggacagattctgttccgaatcaccgatgcggcgtcagcaggactggcctagcggaggctctgggagggtggctgccaggcccggcctgggctttgggtctccccggactacccagagctgggatgcgtggcttctgctgccgggccgactggctgctcagccccagcccttgttaatggacttggaggaatgattccatgccaaagctttgcaaggctcgcagtgaccaggcgcccgacatgggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccagtgattgccgagctgcctcccaaagtgagcgtcttcgtcccaccccgcgacggcttcttcggcaacccccgcaagtccaagctcatctgccaggccacgggtttcagtccccggcagattcaggtgtcctggctgcgcgaggggaagcaggtggggtctggcgtcaccacggaccaggtgcaggctgaggcaaaggagtctgggcccacgacctacaaggtgaccagcacactgaccatcaaagagagcgactggctcagccagagcatgttcacctgccgggtggatcacaggggcctgaccttccagcagaatgcgtcctccatgtgtgtccccgatcaagacacagccatccgggtcttcgccatccccccatcctttgccagcatcttcctcaccaagtccaccaagttgacctgcctggtcacagacctgaccacctatgacagcgtgaccatctcctggacccgccagaatggccaagctgtgaaaacccacaccaacatctccgagagccaccccaatgccactttcagcgccgtgggtgaggccagcatctgcgaggatgactggaattccggggagaggttcacgtgcaccgtgacccacacagacctgccctcgccactgaagcagaccatctcccggcccaaaggggtggccctgcacaggcccgatgtctacttgctgccaccagcccgggagcagctgaacttgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccatgaggccctgcccaacagggtcaccgagaggaccgtggacaagtccaccgagggggaggtgagcgccgacgaggagggctttgagaacctgtgggccaccgcctccaccttcatcgtcctcttcctcctgagcctcttctacagtaccaccgtcaccttgttcaaggtgaaatgatcccaacagaagaacatcggagaccagagagaggaactcaaagggcgcagctccgggtctggggtcctgcctgcgtggcctgttggcacgtgtttctcttccccgcccggcctccagttgtgtgctctcacacaggcttccttctcgaccggcaggggctggctggcttgcaggcacgaggtgggctctaccccacactgctttgctgtgtatacgcttgttgccctgaaataaatatgcacattttatccatgaa

SEQ ID NO: 1915 - DNA, 3318 bp, Homo sapiens
gcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggaaaaaaaaaaaaa

SEQ ID NO: 1916 - DNA, 3587 bp, Homo sapiens
gaattcagcacaatgaaggagccatggaatgccaatttaacgtcagtcttgtacttgaagggaaaaaaaacacttgtaatggtggcaacagtgaagctgttcctttaacatccccaaatatagccaagtttagcactccaccagccatcctcagaaagaagagaaaaatgcgagtgggtcattccccaggcagcgaacttagggatggctcattgaacgatggtggtaatatggcgctaaaacatacaccactgaaaacactaccattttctccttcacagtttttcaacacatgtcctggtaatgaacaacttaatatagaaaatccttcatttacatcaacccctatttgtgggcagaaagctctcattacaactcctcttcataaggaaacaactcccaaagatcaaaaggaaaatgtagggtttagaacacctactattagaagatctatactgggtaccacaccaagaactcctactccttttaagaatgcgcttgctgctcaggagaaaaaatatggacctcttaaaattgtgtcccagccacttgctttcttggaagaagatattcgggaagttttaaaagaagaaactggaacagacctattcctcaaagaggaagatgaacctgcttacaaaagctgcaaacaagagaataccgcttctgggaagaaagtcagaaaatcactagtcttagataattgggaaaaagaagaatcaggcactcaactgttgactgaagacatttcagacatgcagtcagaaaatagatttactacatccttattaatgataccattattggaaatacatgacaataggtgcaacttgattcctgaaaaacaagatataaattcaaccaacaaaacatatacacttactaaaaagaaaccaaaccctaacacttccaaagttgtcaaattggaaaagaatcttcagtcaaattgtgaatgggaaacagtggtttatgggaagacagaagaccaacttattatgactgaacaagcaagaagatatctgagtacttacacagctaccagtagtacttcaagagctctcatactgtaattgttattaaaattgatgaaatgccccactcccttactgcagtctctactaaattaggttgcagtgaaatttttctcaattagttgtttttaaagttgtaagatacccttttaatacagcatcttttttctattctatatagtaggcagaaagctagtaagtcacttaaggggtagatagtttcatagtttattttttaagagatgagatttttaaaaattgtttttaaagaacaagatgggaaaataatagaatgttcatggatttctaaaagtaaattctcatatattttcttcacaagatatatgttgctactctcttgatgctgcagttttgttatagataggtgtatgagtatatatgatttctgaaattagtctatgtatggaaagcacacatgattttatgaaggtacttttgcccatgtgctgatttacttaggctaccatttacaaagaaacacattgaaaaggaatttaaaggaaggatagaaagttgcactactaattttttgttttttttttcagaagcagtaaaattaactacagtgttaaatgtatttatttgagcatagtactgaaaacaaaaagcattcaaaaaagagttttttctttattagtaaatagtattttcttaatctcagaggagctgagagttttgttgaatgtattgtacagtatgtaggagcaggagaactttgtaaattggaaagaagtctgtttttataatttatttttatttttaaagcttaaatgtagatatttatagtatacagggagcctagaagccaatgttgtttcctgttattacagctaacacagtaaagaataattttgactttaagtatgaaacagtagtaagttatagctgcaaagaatacaatatctatactgtatgtcacatctacctaaatgttgcactatgccctttaaatcatgctggttataaagtagttctaaaaatgtactaaataataatttaatattttctttttaaattatatcgggggtggtcatatacattaatctggtgatttgtatatgtgtttgaaattttttgcttttgtttaaaaaaaaataatatggtaccttggtccctaaaaacagtctgcacttagaagttatatttactcagtgtttcagaagtggagaacttatcttttatttataaaaatattttgtccttttttaaatgttttgtgtttctctacaggttacaacagttgcttcagttgcctgttttaggtgtttgcacttattttatttcttcttgaaagaatttttatttgcttttgtggtagagattatatgtaattttttttcagtcatataatggtgtgctgtcaacttaaacactgacaggtaaatagaattgtacactgtagtttgaattatttataattgacacactctctccctctccactcctgaagtatgctgctatagaaaatagcagaatcggcttgctgctacgagagaaggaaagagcgaccaccacttgcactgtgtgaaaagataaaaaacaaatgatggcaagttctcaagttaactaaatggaatcaaccattaccaggcaaattcttgcaaataccaaaatactactatgccttataaaacaaaatgaaagcaggttaagattttctgctctgtttgtatgttaatagaaatggaaatactaagtattttaatgcttagctattgaacagtagacctaaaagggttttaagctatttaaatctacttgctagtttttgcatattttatatatatatatatttatatatatatatagtgagaagtgaagaaaatgtatggtactaagattatgccttattgataaatagataaaccaatttgaatcctcttagcatgtttaagtatgttgattgctttctaattaatgaacttctcacagaaatttcacttagtgaaaccaatgattgtagcaaactcatactggatcatttcagttaccttgaactaatagcacataatggttttttgttgttgttgtttttaatgtagcccttacctggatatacatagtctgcaatcaccaaagtataatatcttgtaaggctatattttttaaagcatattttttcttgagcattaaattatcctaaatggtaatatattgtggataagtctgggcttattggacataatacatatttgggttggtactggttgaatccttcagttaactgctttgttgctttttgcaagattttttatcttaaacatgtcaggcatcttaagtcacctttatactgttttgttcctctgagtttctttcagtatgttatacaaatgccagacataacatgtagcagccatacttgcatggaaactgactacacatacataatactgcattttattgtaaggttttcacattaatacagcaattaccctgactaaattgagttttgtgatatatggaaaacttcattgtaagagaatcttgcatacaatgttgactattaacatccaaaataaagcatctgtgtacaag

SEQ ID NO: 1917 - DNA, 549 bp, Homo sapiens
cctctcttccacaggaggcctacacgccgccgcttgtgctgcagccatgtctctagtgatccctgaaaagttccagcatattttgcgagtactcaacaccaacattgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagttatatacaaaaaaa

SEQ ID NO: 1918 - DNA, 454 bp, Homo sapiens
ctcagctcctggggctcctgctgctctggctctcaggtgccacatgtgacatccagatgacccagtctccatcctccctgtctgcatctgtaggagacagagtcaccatcacttgccaggcgactcaggacattggcaactatttaaattggtatcagcacaaaccagggaaagcccctaacctcctgatctacgatgcatccaatttggaaacaggggtcccatcaaggttcagtggacgtggatctgggacacattttactttcaccatcagcagcctgcagcctgaagatattgcaacatattactgtcaacagtatggtaatctcccattcactttcggccctgggaccaaagtgcatatcaaacgaactgtggctgcaccatctgtcttcatcttccgccatctgatgagcagttgaaatctggactgcctctgttgtgtgcctgctga

SEQ ID NO: 1919 - DNA, 2343 bp, Homo sapiens
ggaagttgactggaccagggagatgaccacagctgctgacctctcactcactgctgttcttccttgggtgaaactggcatttctacattttcttacagcacatttggggaatacaaaaaggcctttcttaaaaactattcttgtcttgttttcatgttgattctattgcaaaagagagttatatgagccacctcatacggaatttctaaattcaaacctctagagagatttacccaagtgctttgctttgcagtttgggaggatggatttgaagagagattgatttttttgtaggcaatcaccggccacagttgctcattctaaagctgactgctctgtaaatcacccagtgcttcatgccaccctttctcctcttgctgtgccacacgttatctgcctttaaagcagcagcactggtgtctgtaaaggccttaaccctggagtagtgatggagccaagacccacccctttgacagtgccagctttccaacacagagagctgagtatgggtctaggaagtgagagcaatgtaaaacaatagaaagcaacagttcagagcactgcatcaagtgtactgtgctggaaaggtccgccataggaaatatggtcctccatactcctcagacaacagccttccgaaagcaaacctgtccctacctgcagatgattaaccatctatgaaccggctgggtaagcaacaagtgccatctttcatggagctgagccttaaagatcctccagtcctaaagctgacgggaagaaggtaggtgggagcagcgctgaggtttttggaacgtcctcaagtgctgtgacaccgataaactcatctttggaaaaggaacccgtgtgactgtggaaccaagaagtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacagatcacgtaaaaccaaaggaaactgaaaacacaaagcaaccttcaaagagctgccataaacccaaagccatagttcataccgagaaggtgaacatgatgtccctcacagtgcttgggctacgaatgctgtttgcaaagactgttgccgtcaattttctcttgactgccaagttatttttcttgtaaggctgactggcatgaggaagctacactcctgaagaaaccaaaggcttacaaaaatgcatctccttggcttctgacttctttgtgattcaagttgacctgtcatagccttgttaaaatggctgctagccaaaccactttttcttcaaagacaacaaacccagctcatcctccagcttgatgggaagacaaaagtcctggggaaggggggtttatgtcctaactgctttgtatgctgttttataaagggatagaaggatataaaaagatataggactctttttttactcctacaagtgatacactttgaaaatgatgttttgttccttttgactttctttaccttttgaagtagaaagtgggaaccaacaggttcacagcttcattcctcatgaggcaaataggccttgggagaagaagagcgggtgcccttttatctaaacatggaaggctctgctcaactgagcactagatttgctacaaaccagcatcatcttcttcctcctgtcctcacggcttgtcccaccctctatgttcacttcaggagccacactagagattctgcatggcgtggaggacaaagtttcagcacgttctgcctctcctaatactttacaaatgagattacatttgaatttgctaatactttatgagcaggcaatgaggtttccaaaatctcatctaaatactctccaatctattagcaaaaatcagagtaaaatacagaggaaaggcactgctttctgttaattgattagctccctctgagttccaggcactatgctgagagtacaaagaagacacaagtctgctttcaagcaactcactgtgaaagtgtttttgaagggaggaacagaaatgagacccctatctttccctataaaaacaacatttttactgtcttttgcctgccaatctgtatttgaaaccattggacactgattctctggcctgggactttggcattgatggttttctgcctttcttctcagcctctgcctctattgcatttattaaact

SEQ ID NO: 1920 - DNA, 3273 bp, Homo sapiens
gaattcggcacgagcgagtcgcgacgtcgtcggcaagcggccgccttccacgtaacgcgcgccggcgggggagggcgttggcgcggagccgacgggaacgtccgcgctgcggagcagggcagggaagccgggaggcgggcccggcccgagcttgtccttgtcgcgcaggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagcactgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagcaatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcatgcaattctgcacgccacatgggtgtggtcatgcaatcatcagttggccgccatcagtgtaaatagagcttaaagtcatggtttggctgcataaaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagatcgcttaaacccaggcggcagaggttgcagtgagccaagatcgcgccactgcactccagcctcagcaatagagtgagactgtctcaaaaaaaaaa

SEQ ID NO: 1921 - DNA, 1438 bp, Homo sapiens
gcggcggatgcagtacaaccggcgctttgtcaacgttgtgcccacctttggcaagaagaagggcaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagaccctaaccccatcatcgacggccgcaaggccaacgtgaacctggcatatctgggcgccaagccttggtgtctccagacgggctttgccattggcgtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggtctacgcccagtacccaccggccacctatgaccagtacccatacgccgcctcgcctgccacggctgacagcttcgtgggctacagctaccctgccgccgtgcaccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggacttttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtctgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaacctaggaa

SEQ ID NO: 1922 - DNA, 334 bp, Homo sapiens
tctgagctcacgcagccgccctcagtgtctgcggccccaggacagagggtcaccatctcttgctctggaagcagctccaacattgggaagaattatgtatcctggtaccagcaactcccaggaacagcccccaaactcctcatctataaaaataataagcgaccctcagggattcctgaccgattctctggctccaagtctggcacgtcagccaccctgggcatcaccagactccagactggggacgaggccgattattactgcggaacatgggatagcagcctgagtggtggccgggggatattcggcggcgggaccaagctgaccgtcctag

SEQ ID NO: 1923 - DNA, 735 bp, Homo sapiens
cgacatcagagatgaggacagcattgctgctccttgcagccctggctgtggctacagggccagcccttaccctgcgctgccacgtgtgcaccagctccagcaactgcaagcattctgtggtctgcccggccagctctcgcttctgcaagaccacgaacacagtggagcctctgagggggaatctggtgaagaaggactgtgcggagtcgtgcacacccagctacaccctgcaaggccaggtcagcagcggcaccagctccacccagtgctgccaggaggacctgtgcaatgagaagctgcacaacgctgcacccacccgcaccgccctcgcccacagtgccctcagcctggggctggccctgagcctcctggccgtcatcttagcccccagcctgtgaccttccccccagggaaggcccctcatgcctttccttccctttctctggggattccacacctctcttccccagccggcaacgggggtgccaggagccccaggctgagggcttccccgaaagtctgggaccaggtccaggtgggcatggaatgctgatgacttggagcaggccccacagaccccacagaggatgaagccaccccacagaggatgcagcccccagctgcatggaaggtggaggacagaagccctgtggatccccggatttcacactccttctgttttgttgccgtttattttgtactcaaatctctacatggagataaatgatttaaacc

SEQ ID NO: 1924 - DNA, 1793 bp, Homo sapiens
gcaaagccagctgggctcctgagtccggtgggtacttggagaacttactacgtctagctggaggattgtaaatgcaccaatcagcatgctgtgtctagctcaagattttctccatccccttattttgggccagtggctgtcattacatatgagatgagtctcttgaagactacagatgaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagagaacaaagtcgtggacaaccaggctgggacccagggccagctgaaggtgctgggtgccaacctctggtggccgtacctgatgcacgaacaccccgcctacctgtactcctgggaggatggtgattgctcacaccaaagccttggacccctcccagcctgtgacctttgggaccaactccacctacgcagcagacaagggggctctgtatgtggatgtgatccgtgtgaacagctactactcttggtatcgcaactacgggcacctggagttgattcggctgcagctggccgcccagtttgagaattggtgtgagacatcacaatcccattattcagagcgcgtatggagtggaaacgcttgtagggtttcaccagggctggtgaattaccagatctccgtcaagtgcagtaaccagttcaagttggaagtatgtcttttgaatgcagaaaacaaagtcgtggacaaccaggctgggacccagggccagctgaaggtgctggtgccaacctctggtggccgtacctgatgcacgaacaccccgcctacctgtactcgtgggaggatggtgattgctcacaccaaagccttggacccctcccagcctgtgacctttgggaccaactccacctacgcagcagacaagggggctctgtatgtggatgtgatccgtgtgaacagctactactcttggtatcgcaactacgggcacctggagttgattcggctgcaggccctgcagctggccgcccagtttgtgaattggtgtaagacatcacaatcccattattcagagcgcgtatggagtggaaacgcttgtagggtttcaccagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcatttcaagatgaaaatggaccagccgcagtggctcacgcctgtaataccagcactttgggaggctgaggcgggcggatcacttgaggtcaagagtttgaaactagcctggccaacgtggcaaaactccatctctattaaagatacaaaaattagccaggcatagtggtgcatgcctgtagtcccagctacttgggatgctgaggcaggaagaattgcttgaacctgggaggcagagtctgcggtgaccgagatcatgccactgcactccagcctgggtgacagagccagactccgtctctactaaaaaaaaaaaaaaaaaaaaaa

SEQ ID NO: 1925 - DNA, 334 bp, Homo sapiens
cagtctgtgctgacgcagccgccctcagtgtctggggccgcagggcagggggtcaccatctcctgcactgggagcaactccaacgtcggggcaggttatgatgtgcactggtaccagcagcttccaggaaaagcccccaaactcgtcatccatggtaatagcaatcggccctcaggggtccctggccgattctctggctccaagtctggcgcctcagcctccctggccatcactggactccagtctgaggatgaggctgattattactgccagacctatgacagcaggctgaatatttgcgtgttcggcggggggaccaggctgaccgtcgtag

SEQ ID NO: 1926 - DNA, 322 bp, Homo sapiens
actcagccaccctcagcgtctgggaccccagggcagagggtcaccatctcttgttctggaagcagctccaacatcggggaagaaattactgtaaactggtaccagcagcttccaggaacagcccccaaactcctcatctatagtaataatcagcggccctcaggggtccctgaccgattctctggctccaagtctggcacctcagcctccctggccatcactgggctccagtctgaggatgaggctgattattactggcagtcctatgacaggagtctgagtggtgtggtattcggcggagggaccaagctgaccgtcctag

SEQ ID NO: 1927 - DNA, 2606 bp, Homo sapiens
ctagaattcagcggccgctgaattctagcgagcaggcggcaggcacggtccgtgcggagaggcgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaattccagtggagaagctagtgaaaggacgtttccaggacaacctggattttattcaatggtttaagaaattctatgatgctaactacgatgggaaggagtatgatcctgtagaggcacgacaagggcaagatgcaattcctcctcctgaccctggtgaacagatcttcaacctgccaaaaaagtctcaccatgcaaactcccccacagcaggtgcagctaaatcaagtccagcagctaaaccaggatccacaccttctcgaccctcatcagccaaaagggcttcttccagtggctcagcatccaaatccgataaagatttagaaacgcaggtcatacagcttaatgaacaggtacattcattaaaacttgcccttgaaggcgtggaaaaggaaagggatttctactttgggaagttgagagagatcgagctactctgccaagaacacgggcaggaaaatgatgacctcgtgcagagactaatggacatcctgtatgcttcagaagaacacgagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatctgccgttaccatcaacgcactgttgcatatgccagccactgcgcttggttcccattttctttgctaaggtgtattagcggacggccctctggccacctacccgagagatcgtagggtcacattcatccaacttcaccacttggctgcttgagattggttctgctcttttcttcattcctttccagaacaactctttcccaccccaacaccactgccaccacccctctttttatcctggtgtgaaacaatggtaatttgatatatggtatttatattggcatttttcaacccagtgtcactagatgtcacacacatttgtggtgctttgatgtttgcaagtctaacctctgaacataaatttggtcaaataattggaacaaagggaaacagatacttgatatgaaagccataatgacggtgacttgtgtcgtgggggaaaacataaggtcattttctccctctactcacaatactaaagggaaaaaatggattcaaagctaggatttcagggcccagcagtgttcctccatcagcatgttagacaactacacagtatgttgttagttttgaaagacattcactcaaggaaaacaccatctcaactttgcccgctcaccatgtcccttgcccccatgtagcccatttcccaggttatgctcttttctttctcagggtcctctttggtgggcagccactccccgagatgttgccatcagttttctgcagtccaaagagggtatggttaggtacgggtcttcctgcctcattcctcttcctctttgtgtaggtttcagccacaaaactgtcattcactctaggggacccctactaaagggtaacttcaggtgtgcagccctgagctccaaggctctgcaccatgccacacacttgctgtaaggctagaagtgaagaccttattaataggagcataattgcgagggagaatcatggttctgcagtctggtgtagacactggaataacagcacagaaaaatctatgactcccaatatcttctagaataaagaattttccctctttaacacaagggccctccttgtcattgaccttagctaaaccatggcaattcataaatagaggaaacattaatgaattaaaagcattccttattttttaactaatatttgtacattttcttagtctctttccaagtctttgcctcttttttttctttatttttattttttcctttgacagatggtatcccttcctggatcattcatttcaccttggtttctaactttaggtttactttcacttgttatttgacttagcaggtgcaacaaaaacaagaaacaaatgtgcccaccccactttccgcttaactgaaaagcttaaaataaatttccgaattatg

SEQ ID NO: 1928 - DNA, 1860 bp, Homo sapiens
gggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacggagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctagaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgtaaacattttcattcttaaaattatactcatggtaataatttgaaagtaaaaaaaaaaaaaaa

SEQ ID NO: 1929 - DNA, 4915 bp, Homo sapiens
gagaatcagagagagagagagagtctgtgtctctgggaaagaagaacatctctgcttcacagtgatttgcgctgggggagaggcatcaattggcttcggacccaagggggagacgagaccaggtcaccccggttaagaccaagtgagcgttgcccctccctctcccaactctctacccgggaatgtctcggcgaaagcagcggaaaccccaacagttaatctcggactgcgaaggtcccagcgcgtctgagaacggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtcttcagggcatttcctggtcgctgccacaggtacagcggctgggggaggcgggggcctgatcttggccagtcccaagctgggagcaaccccattacctccagaatcgacccctgcaccccctcctcctccaccaccccctccgcccccaggggtaggcagtggccacttgaatatccccctgatcttggaagagctacgggtgctgcagcagcggcagatccatcagatgcagatgactgagcaaatctgcaggcaggtgctgttgcttggctccttaggccagacggtgggtgcccctgccagtccctcagagctacctgggacagggactgcctcttccaccaagcccctactacccctcttcagccccatcaagcctgtccaaaccagcaagacactggcatcttcctcctcctcctcctcttcctcttcaggggcagaaacgcccaagcaggccttcttccacctttaccacccactggggtcacagcatcctttctctgctggaggggttgggcgaagccacaaacccacccctgccccttccccagccttgccaggcagcacagatcagctgattgcctcgcctcatctggcattcccaagcaccacgggactactggcagcacagtgtcttggggcagcccgaggccttgaggccactgcctccccagggctcctgaagccaaagaatggaagtggtgagctgagctacggagaagtgatgggtcccttggagaagcctggtggaaggcacaaatgccgcttctgtgccaaagtatttggcagtgacagtgccctgcagatccaccttcgttcccacacgggtgagaggccctataagtgcaatgtctgtggaaaccgttttaccacccgtggcaacctcaaagtgcatttccaccggcatcgtgagaagtacccacatgtgcagatgaacccacacccagtaccagagcacctagactatgtcattaccagcagtggcttgccttatggtatgtccgtgccaccagagaaggccgaggaggaggcagccactccaggtggaggggttgagcgcaagcctctggtggcctccacaacagcactcagtgccacagagagcctgactctgctctccaccagtgcaggcacagccacggctccaggactccctgctttcaataagtttgtgctcatgaaagcagtggaacccaagaataaagctgatgaaaacacccccccagggagtgagggctcagccatcagtggagtggcagaaagtagcacggcaactctcatgcaactaagtaagttgatgacttcactaccaagctgggcactgcttaccaaccacttcaagtccactggcagcttcccgcttcccctatgtgctagagccttgggggcctcaccctctgagacatcaaagctgcagcaactggtagaaaagattgaccggcaaggagctgtggcggtgacctcagctgcctcaggagcccccaccacctctgcccctgcaccttcatcctcagcctcttctggacctaaccagtgtgtcatctgtctccgagtgcttagctgtcctcgggccctacgccttcattatggccaacatggaggtgagaggcccttcaaatgcaaagtgtgtggcagagccttctccaccaggggtaatctgcgtgcacatttcgtgggccacaaggccagtccagctgcccgggcacagaattcctgccccatctgccagaagaagttcaccaatgctgtcactctgcagcagcatgtccggatgcacctggggggccagatccccaacggtggtactgcactccctgaaggtggaggagctgctcaggagaatggctccgagcaatctacagtctccggagcagggagtttcccccagcagcagtcccagcagccatcaccggaagaggagttgtctgaggaggaggaagaggaggatgaggaagaagaggaagatgtgactgatgaagattccctggcagggagaggctcagagagtggaggtgagaaggcaatatcagtgagaggtgattcagaagaggcatctggggcagaggaggaggtggggacagtggcggcagcagccacagctgggaaggagatggacagtaatgagaaaactactcaacagtcttctttgccaccaccaccaccacctgacagcctggatcagcctcagccaatggagcagggaagcagtggtgttttaggaggcaaggaagaggggggcaaaccggagagaagctcaagtccggcatcagcactcaccccagaaggggaagccaccagcgtgaccttggtagaggagctgagcctgcaggaggcaatgagaaaggagccaggagagagcagcagcagaaaggcctgcgaagtgtgtggccaggcctttccctcccaggcagctctggaggagcatcagaagacccaccccaaggaggggccgctcttcacttgtgttttctgcaggcagggctttcttgagcgggctaccctcaagaagcatatgctcctggcacaccaccaggtacagccctttgccccccatggccctcagaatattgctgctctttctctagtccctggctgttcgccttccatcacctccacagggctctccccctttccccgaaaagatgaccccacgatcccatgagcctgtttttctgtacctgctgctctttgtcccacagagcagaaacagcttcacaaaaggacctcccagagttatgagccctgattttgtctttttctctaagttcttaacatgttatgtccctagtggcttttctgtagtccctgagcttggaaattactgtgcttacaaggggatggccccctaaggaatttttcttccctcctcattctttgtacctgaggaacatagattctctgcagctttctcaaggggaaccctctccagcttccctggtgtgacccttcttccccctcctctctcctctccctttccctttggtaggtgcacctgagcacctacatttggcattgcagcctagccaaaaagggctggcagctgtctctggagggcccagtgccactcctctggggtgacctttctgctcagctggtgggtatgggtcccctatctttctagaaccagtatgtggcattcctgtcaaatgggctgcccatgaagccctggaattccagctccacctccactaccactccaagcctggccccaccagtgctgtttggcctaggaactgtggctgggaaggtgcctccaacaatgggatccagggaagccaaggagaagacagcccccctcctatttcagcctcctgcacccaaggcagtgcctgagaagcccatcatagacaagaagtagcaaactgtacattccttcttcctccccctgctccagaaggtgccggtactgaagatgctccagtaattggtgacccaaccctaggaagtagggagaaatgaaggaagggcataggaaattttcccaggtaaatcccctgatggtcacattaaggtaaaggttttggctggtcagtgtgccaagacctctccagcttctcattcatgatgacctctcaaagttgggaaacaagctgatttcttgccaagaggtctcccaggagatatttgggaaatgtgaagttcgtatctttaaggagcacttttggtcagcatggttgatgaactaatgatgagagagttaaggaatgttgctagaacatagggcttgctggtacctatgtgactaagaaagggacatgatgtaagggaaaaggcctcaaattcttgtgaatgtggacattctcgttaatattcttttgggctaatagtgacatagtgtgcagaggtgtaccagggatcatgggggatttcctagcactagtatgcttctagttttagataactccctcctttattccctggccccttgtattttccttatcttcctctttcaagacccctacccattttgcctatccgtaggctggggcttgtgtctttgtcattgtctggttcttaagagtcccagactttgggagaccagctccaggtggcgtcctccctgcctctccgtcttgtaatgagttgtagtatttactcttaacataggatcatttggaacaggagttctgaggaggagagagtgagggttttgctattgactgacttgaacgatggcttctcctcaagctgtaggctccagagcttcctaacctagtaaaatgtcaagaacagacgggagatattagtgtctttccctctatcattaaaggtgttttaaccaagaaaaaaagaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1930 - DNA, 2046 bp, Homo sapiens
ggatcttactgtggtggccgcgccttcagctgcatctcggcctgtgggccccggcccggccgctgctgcatcaccgctgccccctaccgtggcatctcctgctaccgcggcctcaccgggggcttcggcagccacagcgtgtgcggaggctttcgggccggctcctgcggacgcgacttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcagattcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaaatcagacctggaggccaatgtggaggccctgatccaggagatcgacttcctgaggcggctgtatgaggaggagatccgcgttctccagtcccacatctcagacacctccgtggttgtcaagctggacaacagccgggacctgaacatggactgcatcattgccgagatcaaggcacagtacgatgacattgtcacccgtagccgggctgaggccgagtcctggtaccgcagcaagtgtgaggagatgaaggccacggtgatcaggcacggggagaccctgcgccgcaccaaggaggagatcaacgagctgaaccgcatgatccagaggctgacggctgaggtggagaatgccaagtgccagaattccaagctggaggctgcggtggctcagtctgagcagcagggtgaggcggccctcagcgatgcccgctgcaagttggccgagctggagggtgccctgcagaaggccaagcaggacatggcctgcctgatcagggagtaccaggaggtgatgaactccaagctgggcctggacatcgagatcgccacctacaggcgcctgctggagggcgaggagcagaggctgtgcgagggcgtcggctcggtgaatgtctgcgtcagcagctcccgcggtggcgttgtctgtggcgatctctgcgcctccactactgcccctgttgtctccaccagagtcagtagcgtccccagcaacagcaacgtggtggtgggcactactaacgcctgcgccccctccgcccgggttggcgtctgcggcggcagctgtaagaggtgctaggaggctgccgcctccgccagcgcctgtcgccgtcactctccacccagccagtacctcgcgccaggagaacgcgccgcccgcgccggcctcccaatagccgccgcccgctgcctgcactctaagcgctctccccacgtccgctccgggagccatccccggtcgcaggagtccggggagggccgggaggcgccatggtctctctctgtagcctttcctggtagtcaatttgttgtcccgaggattcatctttttcttcctcctaccttctgttttttttttcatgtatgcattggtcttgcctgagctcttcctcaaagcttggaggaacgggggagggcccgggaatgtccctgtctgcacgacctgggactctgcccatgtgcttttgcctgtggaatggagacgcggaccctggatagtggttctatgactctgcgagggacaggcccacgcgtgtggggagaacatctccttccggggctgccctcaagagcttctgaaaaactaatgactctgctgccttctcctttgtctttgtttcactctgtgtttccaataaactcattgtagcgaatcaaaaaaaaaaaaaaaaaa

SEQ ID NO: 1931 - DNA, 3740 bp, Homo sapiens
aggaagcctcaagacgcggagcagcggcaggaaggagcccccggcagcccggaggagcatgggcaccttgcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaagatggtaaggttgaagttacaaaagaaggtgtgaagttgtgtaccatgggtccaggaaaagtgtttggggaattggctattctttacaactgtacccggacagcgaccgtcaagactcttgtaaatgtaaaactctgggccattgatcgacaatgttttcaaacaataatgatgaggacaggactcatcaagcataccgagtatatggaatttttaaaaagcgttccaacattccagagccttcctgaagagatcctcagcaagcttgctgatgtccttgaagagacccactatgaaaatggagaatatattatcaggcaaggtgcaagaggggacaccttctttatcatcagcaaaggaacggtaaatgtcactcgtgaagactcaccgagtgaagacccagtctttcttagaactttaggaaaaggagactggtttggagagaaagccttgcagggggaagatgtgagaacagcaaacgtaattgctgcagaagctgtaacctgccttgtgattgacagagactcttttaaacatttgattggagggctggatgatgtttctaataaagcatatgaagatgcagaagctaaagcaaaatatgaagctgaagcggctttcttcgccaacctgaagctgtctgatttcaacatcattgatacccttggagttggaggtttcggacgagtagaactggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgagactgtacagaacatttaaggacagcaaatatttgtatatgttgatggaagcttgtctaggtggagagctctggaccattctcagggatagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcagcccacctttctcaggcccagatcctatgaaaacctataacatcatattgagggggattgacatgatagaatttccaaagaagattgccaaaaatgctgctaatttaattaaaaaactatgcagggacaatccatcagaaagattagggaatttgaaaaatggagtaaaagacattcaaaagcacaaatggtttgagggctttaactgggaaggcttaagaaaaggtaccttgacacctcctataataccaagtgttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttatcgcttagatgacaatagtgctctttacatgttttctgtttgaacctaaaatagcagttgacatggtggtcctgaagcaaagcctttcaccagtaaagagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattacagctgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagcaacacaaattcaaatcattatacgtgtagccagaaactcaagcattttcactaaagttattaaaccaaactcctgtccaatttgacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaaccccg

SEQ ID NO: 1932 - DNA, 1673 bp, Homo sapiens
agcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtaattatggcatgcactgggtccgccaggctccaggcaaggggctggagtgggtggcagctatatggtatgatggaagtaataaatactatgcagactccgtgaagggccgattcaccatctccagagacaattccaagaacacgttgtatatgcaaatgaacagcctgagagccgaggacacggctgtgtattattgtgcgagagagggtcggtgggtacgatatactacggtgactactatcggatactactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatgagtgcgacggccggcaagcccccgctccccgggctctcgcggtcgcacgaggatgcttggcacgtaccccgtctacatacttcccaggcacccagcatggaaataaagcacccaccactgccctgggccctgcaaaaaaaaaaaaaaaaaaaaaaaaaaaaaaaaaaaaaaaaaa

SEQ ID NO: 1933 - DNA, 1132 bp, Homo sapiens
aagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggactatctcaagagattttatctctatgactcagaaacaaaaaatgccaacagtttagaagccaaactcaaggagatgcaaaaattctttggcctacctataactggaatgttaaactcccgcgtcatagaaataatgcagaagcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttattggttaaactcctttatggtgtgactgtgtcttattccatctatgagctttgtcagtgcgcgtagatgtcaataaatgttacatacacaaataaataaaatatttaggccatggtaaatttaccgaattccgccgatactgacgggc

SEQ ID NO: 1934 - DNA, 313 bp, Homo sapiens
caggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacggatcaaccctaacagtggtggcacacactatgcacagaagtttcagggcagggtcaccatgaccagggacacgtccatcagcacagcctacatggagctgagcaggctgagatctgacgacacggccgtgtattactgtgcgagaggttaccagatggatgtga

SEQ ID NO: 1935 - DNA, 2093 bp, Homo sapiens
gccccatgcaagtccaaaacccagcaggcaaatcttagagctccaaaatgacctcctttgactccatgtgtcacatctaggtgatgcaagaagtgggttcccagggtcttgggcagccccgcccctgtggctttgcagggtacggcccccccttctggctgcattgagtgtctgcagcttttccaggcacacagtgcaagctgtcagtggatctaccattctggggtctggaggatggtggcccctttgtgacagctctgcttggcagtaccccagtggggactctgtgtgggggctccaaccccatatttccctttgacactgccctagcagaggttatccatgaggcccccccgctcccgtgcacagcaaacttttgcctggatttccaggcattttcatacatcttctgaaatctaggcggaggttcatgaacgttaattcttcggtgcatctgcaggcttaacaccacctagaacctgaaaggcttggaacttgcaccctctgaagccatggcctgaggtgtaccttggccccttttacctgtggcaggagcagctgggatgcagggcaccaggttcctaggctgcacacagcagggggttccggactcacaagagcatttttccttctaagcctcctggcctgtgatgggagggtctgctgtgagggtctctaacatgccctggagacatttgccccattgtcttggtgattaacatttggctcctcattacttatgcaaatttctacaacccagtctcctgagaaaatagatttttcttttctgttgcatcatcaggctacaaattttctgaacttttatgctctgcttcttctcgaatgctttgctgcttagaaatttcttctgtcagataccttaaatcatctctctcaagttcaaagttccacagatctctagggaactctagaaaaaaattcttattttgactctttcccgcctatcttatgcccgtttctaatacaggtgcacagtgcctgcagtgtctttgcatagtaagagtgactttactccatttcccaacaaattcctcatctccctctgagaccacctccgcctggaccttattgtccatatcactattaacattttggtcaaagccattcaacaagtctctaggaagttccaaactttcccacattttcctatcctcttctgagccttccaaactgttccagcctctccctgttacccatttccaaagttgcttccacattttcgggtatctttacagcagcagcccactctactggtatcaacttattgtattagtctgttctcacactgcaaataaagacatacctgagactgggtaatttataaaggaaagaggttgaattgactcacagttctgcatggctggggaggcctcacaatcatggtggaaggcaaggaggtgcaaaagcatgtctcacatagtggcaaggcaggagagagcatgtgcaggggagctcccatttataaaaccatcagatctcatgagacttagtcactaccacgagaacagtatggggggaaccatccccatgattcagttatctgcacctggccccacccttgacacgtgggaattattccaatgcaaggtgagatttgggtggggacccatccaaactatgtcagtatgttttgacttctggcttgattgctaggttgcatagaggacaaacatggaaattaatgaagtaccttaatatctggcttcagatcttagacaggatcagagggccagctcaaatttgcaaggaggggaggtagatcccaccattttatgggtgaatggcaaaatcaaacagaaattatgtgggatgggagatactgatgcaggcatctttggaaacattctacttagctaattttatgctaggctttaggtcaagaaggagagagagagctgacatgctgtggtacacacttattgtcccagcgacttggaaagctgaggcaggaggattgcttgatcccaggagtttgaggtagtgtgcgatgatcgttcttgtgaatagccactagccactgaactccagcttgggcaacattgagacaccctgtctcttaatttaaaaaaaaa

SEQ ID NO: 1936 - DNA, 1701 bp, Homo sapiens
cggccggccgccatggctaacgtggctgacacgaagctgtacgacatcctgggcgttcccgcgggcgccagcgagaacgagctgaagaaggcatacagaaagttagccaaggaatatcatcctgataagaatccccaaatgcaggagacaaactttaaagaaataagttttgcatatgaagtactatcaaatcctgagaagcgtgagttatatgacagatacggagagcaaggtcttcgggaaggcagcggcggaggtgggtggcatggattgatattttctctcaccgttttttgtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggtgaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccagagtggaacccggagacattgttctttttgctaccaggagaaaagaacatggaggtatttcagagagatgggaatgatttgcacatgacatataaaataggacttgttgaagctctatgtggatttcagttcacattaagccaccttgatggacgtcagattgtggtgaaatacccccctggcaaagtaattgaaccagggtgtgttcgtgtagttcgaggtgaagggatgccgcagtatcgtaatccctttgaaaaaggtgggctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgtaaaa

SEQ ID NO: 1937 - DNA, 1066 bp, Homo sapiens
aggcggagccaagccagcgacccaccatggagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaaatcacaagatttttgttgtgaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtacggagtccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggcaaaaaaaaaaaaaaaaaaaaaaa

SEQ ID NO: 1938 - DNA, 1664 bp, Homo sapiens
cgggtgactcatttttctgtgtagagactcggtggcccaggcaggaggtgaaagcagccatccggaaggccctggggacccttgtgcctgttgctcgccttcaggtcaccagctgagctgcgataggaaaatctgaatggaggcagcaaacagccaaaacaaacattccccacccggccctgtgcatatgaagtctttcttcccccaactcttgaacgatgatgatattcagacgaagcattgatgttatggaagaaagaaagaaacaaacaaaatatatatatatatgtccaaaaacagacaaatccaagggtgtgaggtaaacgagtgtctgcatttagattccacaaaaccaaaatccatgttgaacaaagttaagtccgtacacagtggctttttgggtgagccgtgtgtgtctgtctgttgtgtgtgtgcctcaagccctgttttcctgcgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccaccttttttattttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaaaaaaaaaaaaaa

SEQ ID NO: 1939 - DNA, 797 bp, Homo sapiens
cataatgattaagtagcccattaacctttccctttaaacaggccttttgatgttagttcttataccaaaaaaaaaaaaaaaaaacccaaaaccaaaaaacaaaccaacaatacatgaagatgtaagggaagagattaatgagatacaattcattaagtataaaaatatgttgtttcaaattcagaataatttaataactcttcgttatttcatatgtatctggaaatgggacagatacgtgtcctgatcctgtcacaagaggtagaattccagcatttggtacgacgttccaagacagggtcaaagtgacattcctgtttcccttgagaccatttccatcgtcaaagaaaaaatattttgttttcatatctttcagcagcagcttcggattatcacctctcaaaacaatcttgtcccataggacaacttggttcagagcattattttttgttgaatattctgctgataaataaagaaacaactgcttaacattccaatcaaatatattctctagatcagcagttatatcaaatgtgataaatcccagatcacttctttctctaggtccagtgaaatcttctacattttttagcatgatccgcgagacgtgcagccgcaccgggacgctcctgtctttgaaggcggtggtgatgaagcagccgaaggtgagcgccgccatcacgctcagcgagaaggcgaacagtgagttcgcccgcgacagcaccgtgttcatcgcgatcgtctcccacgagtccggactccacacgcacacccaggctcccgttccggcggcggac

SEQ ID NO: 1940 - DNA, 663 bp, Homo sapiens
tagttgtatataaaatttaatctcaccgaatgtacagttttcaaatttcacgtgtatattaaggaactgatgcatctgagcattgtcaaacaaacgggaagaagaagttaaagggcagcctggcattgatggctggtggagctctgaagcctgcctctgcaggtgcagacacatccacaaaagtaaccgcagtggaaataagaatcgtcctttcatttcctgagttggcctcaggaaaggaggatgaaattagatttgcagttacattgactattttggcctgtggattcagcagggatccgtatttagtccacttcacttctataaccaaagcccctgggagctggcaggaatccttcctgttgaatgactgggtgatgaagtggatgggcacccagtccagcatgtcctggggcctgggaatttcaaaaggggccacgtaatctgggaagccctgccccacagcaggctcttcacctctgtgctacgagcttacaccggagagcctccagtcagtcttagtttacagccagattgcatagtgtaaccaaataatactggggtccggaccccctccagtgctaagcagtcttgctcagttgtgctatgaagaatagtaagctgtccatatctatttgtggtctgaataatcccagacccctt

SEQ ID NO: 1941 - DNA, 479 bp, Homo sapiens
ttttacaaaataacacaatttattactattttgaaacaaatcacaaaataacattcagaaactcaacatttctaaataacttaattcacaataagtttagtcataaagtcatgctacaaaactcctgtgtataaaagattattaccaaggtattcatagatgttaaaatgttcttcagaatggagttggttctagaagccaaagattctggaatgatgctcgtaatcatgactgccagcctgggagaggagctggctatgcgcatgtgctcttagcttccaactcaccagtcttttgatgggagtgatccctccaggcagtagcacctcagaggcaggtaccctactgatcacagaggcaaagagcctcccacccatataatgttagacaactctacattcatttaaaatctagaggtgggaatgataattcgcaaagcttctattctgagtaggagaactacttgacacatcccccag

SEQ ID NO: 1942 - DNA, 550 bp, Homo sapiens
ccaggtggagtctgatgatctttatttcttagacagccctggactggggctatgaaacacagtcaccagcactatactcactcctagggtggctctgtctgtggcgttcctcaccatccccgggactcatagctcagtgccaccccccgacaccatgccctccagggggaggggacagcgaaggggagaggagggagagccctgcgcctggccctgtcctgagtccaaagattcccatggtgatcagagggcggtgttgggaatgtgggacacccttggccccgcctccctgacctccccactaccccaccaaaccagccttccttcctcctggcacttccagtgtccattcccggcagtgcaaatgtgttaggtggggtagggggtgggatagggagataaatagcagcctggcgttggcactggctggtgctctgtggtgggtatgagtaggggacggggccgccttcctggagacaagctcctgggtgctgtgatcagaagggtctgtagctccagtagctggagaacacggagatcttgtccttga

SEQ ID NO: 1943 - DNA, 556 bp, Homo sapiens
gccaatggctcttgatttttattatttttcacatgggcagcagaagatggagttgtcccatccttgctccccttgcattgaatgtgccttgggtcttaaaaccccggagtgtcattggagccccctcctcttgctcctagtgtaggagggacaaggaggaaagcactgtgagtatgtgtgttggaggggaggggtcccagctccctgagccaggctcagcacccctcagcagctccctgaggccctctctctgtgagacttttgacagacagcaggacagaaacatatagcagagaaagacataggcagactaggagacaggctacacacacacacagagaagctggccccttcctttggcatggttcaccctagccctggggataggatctaagggtagcgtatgggacctgagctttgggcttgcccgagagagagatggggctacttgaattcttgagaccccaaactccgagaccaaagaagttctctctcctgcctaacctggacccacacctcttcatgtccccacccaccacttagagactgagattgt

SEQ ID NO: 1944 - DNA, 584 bp, Homo sapiens
aggggtctggctttctctttagttctcatcacactagggctctcagtcacagagaaggcacttaaatgggaaggccacctgatgcaggccaaccatattcaccccccgcccacccgctctgggggaggggagcacaacgacatcaccacttgacatcccccttggcactggtatgtgggtccccttaaccgttagaccctggggagagcccaaggccttgacctccggaatcgccatgttaggaggaggggcttcagaaacagttggaaggcaggatatcctgggagctgcccccagccagcaggggatcaggcagggggctgtaggagatgggttggcacaggggaaggggacagcttggtcgggcttcctggagatccccaaaccccacagaaggtcccacctcctacagatcccccaaaggcaccggtgaaggatgggcaaggaggcactgatgagctggcgtagagaccccccacacacacttagctggtgggcctagcatatgctgggcacagaaggtgctcaagaaatgtttttttgaatgaatgaacggagcaaaggggtgtgagggacagaggaca

SEQ ID NO: 1945 - DNA, 624 bp, Homo sapiens
gattgtcaaaagcaatttaatttttggaggaaaaactgcatacgcagtacaacttatatctcaggcgaaatgtctcagaatcttcctgctcattggacagaaactcagcttcaccacattgccagccgggagaccatggaagggaactggcgccactgcccccagctgcccttcccaggggcaacttcaccaagatgtggaaatcctgggcccaccccacagtcagtcatcgctccatttcttcctggcaccaccacctccatctggcctgctccccaaccccccagaagcaggtgggcccaggctccaggccagtgcccccatcaagatcagacgtaaggcatcttcccaccgtcgctgtgctccggggacttttccaatccttccttcctctctgtccagaggctgccaggctgagggggccaccgtccaggtggaacaggcacaggcatcggggaatcagatggtatcagtggggatagggcacagcactttcctgggagccatgagacgccagatcttcctctggcagttcccactggctgtgggaagtggttttcataaagggggccaacttccaggaacatctagggctcgggagcaacccagcattgacagtgaatc

SEQ ID NO: 1946 - DNA, 874 bp, Homo sapiens
gaagctataattttatttcattactcttagtacatccacaactatttccacctaaatagatctttaaaataagcatacacaagtattgactattatctacaaatatttattgtaacacttgaatagaactacaggaagcccttggcactgatagaaaatattgattcactgttaggttacaaaaatttatacatagcaaaatttaatgctctttacataaaaaatattagactacttaaacaaaactttcaaaaattcctggtaatagctaccagaattagaaaagtaaaattaggctttagacactgcctcttctagaacactggactctgacagcacctccactgctggaaagaatagttaaatctgtcatgcaacaggaaaacaaaacactaagctattttggaacaactgttctacacagaagagagcttctcttaatttaaaaaaaaaaaaaaatcccaaataggcatttttaggcattaaccaaaaaagagaatccaaatggaatattatacttgatgttcaattttaatagcatcttgataaaggtatgcttcctttcatttgaatacatttctgcacatgtatgttataaaatccaggaaacagccaaaccacaagttaactcttaacaatgaatatacatagttaaccctatagtaagcagcccctttgaaaagcactgatgcacccaacagttatatggatcatttcataaagagcaacacaaagtttaccatcactaatacccagtacctacagtcacttaatgttctggaacacaataatgtaaaaggcaagtttcttttgaaaatggcttaaactcaagcagttctcttgctgaacatcaaactttattattcctgagaaa

SEQ ID NO: 1947 - DNA, 678 bp, Homo sapiens
aaaaatacaatctcttttttattaagaaatcctaatgactgaggtagatgatgctgttgtcagataccgaagtaatttggtttaagatatgaaaatgatgaaaccaagggaaagaaagcactgttttgaaattatcttcttttaaatttagatgcataattaagaatgcttccaatttaaggttctaagcacaaaatccagatatgtcatgttatggacttgcttcctgaagatgatatcagcagttgatagaaagaatccacactcttacagaacagcaaatcataaatggttgtctctgtgaagccagtagctttgcattcgatatttctatctgggctcattccaaatgttcaggatttggattcctgaaggcttcttcagcatttaactaattctttgttggctgaaggggctgggactgtttctccacacacaaactgatctttgtcataaatcacttttataatgagagagcagctaggacacgttgccacgtcttccccattctccaaatcttccttggtgatggagaagttatctccacatgggcagggatagaaatacgtctccgagtcctcgtcatattggaagtcctcgatttccacctcgtcatgaaacactgccatggtcagcgggggtggccgaaggggtaacgccccagcagtccgaggccag

SEQ ID NO: 1948 - DNA, 1292 bp, Homo sapiens
gacaagtgagaaagctttattaaagcacacatacatgtcagcggggtgggaaacaaaagagcaagttacagcccgggatcccaagttatgccttccattacaattgcaatccacaccaaatcaatctttgaaaacattcctccattcggttcatacatacagtagaaaccactgtggctgcccttaatccagtgtgcttataggaaatcagttagcagctgactctgttgaaagggatttcctctctgctatacactccttccacacacaactttgggtagaaacgcttatgagaatagaaaggtcagtttgatcaatgagtaccagaagatgaaacttagctcactagacccttctttgaaaagcctcaacacactacacccatgtaatatgtaggtcaaatttaggaaacaatagcaaaaacaggaactgaaagctcatcaagcaggaagtcagaataacagggagactctgtctacattcccttagagcccttaacagtccccagcctggagaaacactgggccaattgagataacacttggctcttctggttgacacagtgggatgtagaccatgctctgtttgataacacaccccagacgcaaacactaagacagatgtggtacatgaggatgaatatatctcatctttcattcgagaaatgaggagctctctctccaatgactgcagtatcagtttaaaatgcagaaaattcagcatgggctgtgagacactttaccctcagtcactctggtcctctgagatcagctagaagctctcactgggcatcctcgtgatttagtcaaaatacattatctaattaaagtgcttttcaaaagcagctccattataagagtcccccaaaggtctagtaaagatatctagaactggaaaaagcttgggaattctgttagcatttcaaagaaaagcattagaccaaagcaaggtggaaactgcttaaaaactagaaaagttaaatttaaaagccaagttccagaagtttatccaggtagaaaataagttaaaagcataaattggagaggagaaagaggaaggaactactcacctctccccaacattcctgtctttactaaccaaccctgcttcccagagccttaaaacccagactggtcctaatgcgaaaggtagccagggcttcctagggaagtaggaacaatgatagcaagacagaagataaaaagttgttttaaaagctgtttttaagttaagtgaaccttataaagacataagaaaaaatggactctgaaaataaactagattatacacag

SEQ ID NO: 1949 - DNA, 581 bp, Homo sapiens
aacatttgtgaccagttaactttaattttcaaaataaatctgcagtattttgcatgttagtaatacagtgctggtattgacaggtaaaatcatcatctgcttacatagaaaccttcattcaggagcacaccgtaggaggggaacggatacacaataaaaagcaaacgcaggccaagcagcgagccctagagcgtaacaggctggatgtcagatttaaggattatctaatacaactgtttagctgccaatctgataaaggggaagctctcaaccaggttacaaccagaagggaaaaacgtactctgccttttcgtagagcagtggctgtcgtgccttcaacacctggttgaatcagttcatcaacatcgaaactcaattccagttccaagacacagaatttcatcacacaacctattcggtaccccttttcagtggcccacccaaaaccccctcctgccatcgactctctccctcccaaaagaagacatgacgtggctttattattgcagacaagcttcttaagtgaataaagaatgcatacaaaatagtattttaactgaagtcatacaatgaagtctcac

SEQ ID NO: 1950 - DNA, 1365 bp, Homo sapiens
tttttctgaaaaaaaggtttattgcatatggaaatcaatagatatcttttacaaaaaaaggttagaataaagatctcacatttgtaaaggcacatatgaaacattttatagcaagcacaagggcagtgagaacatcaacaaggtccaatatctaaataagactttataaaaacagataggaaacagtgcaaaaaatactgtcaaagtcagttctatacacctcataactgtgtatacaactggcaagcataagcttatttactgatataaaatagcacatagaatagcatgcatagttttattttaggcttttcatattattaaattgatagggagtctataccaaagtacagttgacatgaatagtgataaaaatcactccccagcttagggaatgtcctataaacatctcacccctccctctgcttacaactacagtttggtagtaaggagactgtgcttccatcttgcaaggtggcaagcggccaccacagggggcgaatgtgctctcaggatcccaagtcccaacctggaatgcatttcttacggcaacaacataagagatggtgattaaatgtctgggtcagcccacaaaagccaaccagatctggctatcacagccctccatttgggctgtggtggaggtcagtgggcttctatgggtgacgcaagaaccttaagaacaaaccggtttctaagttggggacttgtctgtacatcgtttcaaaatgaaacctaataaatgtcatttgttttgaatgataccaaaattcacaacattttgtgaaacaaagatcaaggaaagcatcaaaatactgaagtagggagcacaagcctagtccagtgaaacaaactagattagcttgttacttgatgtaacacaagttacataaggttacacatttattagtaatttgcatatttaaacctttttttccactgaagtatcctcaagcacattaattagctattgaaggaacaaaggacatacataggaactcatctctgatgaagagtagctttatgtcagaaaggagaaggctaatgaatttttaagattccaaacagtggcaagaaagttcaaaggaaattgcagtaaaattgtacaatgttcaagttgaaaaaaaaaatggctctgaattacagcattcagttctatgctcaaggtatgtattagctaacactgcagttgtcagaggtgggaggcccctgagaaatgctgagaatgccaggcaccccagttctgagagccaccctagctaaactcaaagcagcattcttgagattttagcaaaaggctccgccccaagccacaaaaagatcccaatccaatcttttcagctttatcctctaaaaccttttgtc

SEQ ID NO: 1951 - DNA, 1100 bp, Homo sapiens
agactaccttttaataaactcaacttcccaatgttaaaaatcactgaatcaaaagatattttcaagcagccttttctcccagatatatattagatataaggaaatcgagtccaatttgaaatgaattttaaaacagcacacaaacatcacaagcccccagcgcacaatataaaatagttctctaaggaatataaacatttagtatattagaatgtgaaattacataggaaaataatctcttcaattagctaaaatcacttgcgaaagattatttattgcacaatttatcagtgggtactaagaataacacagatcctattattctcaacctctaaattcagtacatagtaaaattcattttctcaaactaaggttctatacataatcggagtaaaccctctgttactgagttaggatagggaaaacaaattccttagagttcatgaaaccacttcacaaatcctagaaggcacacattatatttcctatcatagtaagtacatttaagtacttcatatttaaaaaagacaaagctgtacagaatacaaaaagtgtacatttcatccattaaacaaatttacaacttttacgattagttattacagtagaactgacctaacattcacatctaaataattatcacccagttcaatagagcgaacaaagagctgtgctcatttatttatttgataaggctaataacattttatattcacagtagatcagtaagtgtcttggagctcatattgtaaaataaaaaggtttgggccctattgagtcactgggctcattgttaaataactccttgaaaggtgaaggattctggggataaaatcattggctatccctggaaagatccaaaactctgtaaggtaactctgttcacttttcagaaacattttaaaatagggtaatctgaattaaactcagcaagtctaatctaaaaggacaatttaaaatcttagagctggaaaagatttcagtggatcatctatcccaaggttttcaaaatatgttccatggaatactaagaatctatggaggagatacagggttctgcaaatttgacttgaatttaattaaaaaatttttttaaaaaa

SEQ ID NO: 1952 - DNA, 1080 bp, Homo sapiens
ctcttactcattcagattatttattaagagcaaaagtcgggccatcccatcgtgtgatattgcaacatgaaaagtcacatacatactaaggagaccccacagaattgagagcctttcaacagtacagagccatagattacaaagttaaaatacaaatgatcccccagatttggcaggaaacaagtacaatatgaggaggcctggaatggaagggcacttacttttcaataaggcagttacaaaatgggaaaaaaaacccccaaaaccttgtaccccaaaatatactctgatgagcgtacaggacaatagaaatgtaaaagaaggatcctgtataaccctctgtcattggcaaatgtgtgcattaagtgaaagcaactgaagggtttgtgttttaagatgcaagctagatgaaacaactgactgtagacatttctacctcaagaacagttcatatcttgccctaggctgggttctacctcaaaacaccagacccactttaccatttctaaccataaacttggaaacagtctataatacaatgaaaggaataaaaaggcacccctagagcaccatgcttcccaaggcatgatcttgagctcatctgcccttcggttcgactgcccagctcagtaacagggaccaggagccagggccagctgaattacacaacctcaaaggatcgcctggaaggcagatatctgaccaagagatcacagaccaagcacatttcatgagaatttaaatgctaggacaatactacctctcccaatagggcttgaaccctggttttaaataacaggctagatctgttttcccttaccactcattttgcaaaactcaactggcctaaacatttcgctcaatcttgagttctgcaggttggtccctgagagctaggttggccttgggaatttctgctcaattttaagttctcaagaatctgagggcagccgatttagactgaattagagtcatcctataggtcagaaagaagagaatgctagacaggtcaagagggccagaggttggttctgataatgccatatgacctcaggcacatctttttgagttttagtttcc

SEQ ID NO: 1953 - DNA, 1058 bp, Homo sapiens
caattaaatcttttctttttttttatgaaaaaagatcacacagaatttgccaacaaacaaaattccaaaagaaacataaaaaaaaaaaaccaataattcccccaaaaaacaaacccaaagtctggcttttccttccctcaagattgtctggttgaggccttggtttcccttgaaggcttggggcctggttaagtgctttctggggcccaagcagggaccctgggcttgggccggctcctgcctctccctcttctctccctaacaaacacttctctatcctggggggtgagtacagtacacttggcggggtgggcggggggtgtgctggggactgggaggccggtgaagccggtgctagacactataatctaacaggaaataaaaaataatattctgcacgtcagaatgttttttttttataatttcatagctatttttcacagttttaaaaagtttatatatatatttatatatatttatctttatatatataattaaaaagttgactccatttaaaggcttatgatacaggggcggggcgagtctcttggtacaataaaactgtacaggttaagaagtgccacctccctcctgggtggggaggggccaggcgtggccgggcgacagtttcagcaccattggggttttctgtagtgtgagggtttggaccagggtgggcctgtgccgggccctctccacctggtgcctttgacagacactccgggctgcaaccccacccggctctgttccccaagtctaggccatcctgagagggtgggggcagggcccctggcacagtcaggtaggccagctggcatcgggctgccctgtcccatgcacggtgggaggccttggggtgggctccgtgctaagggtgcttgggaagcccagagtgagcgtcagtttggttccttagaagcgcccctccccaccgaatccccagtctgcatggacctgggggcacccgggcccccacgcagcagcagcctggagggccggcctggccaagtgcttgcaacgtgctgggcaggaagggccgtccttcagctcatccttgt

SEQ ID NO: 1954 - DNA, 634 bp, Homo sapiens
ggtccaaaatttttaatagtatacagacaacctgttaattttttttttttttttttttgtaaataacaaacaccactttgttatgaagaccttacaaacctcttcttaagacattcttactctgatccaggcaaaaacacttcaaggtttgtaaatgactctttcctgacataaatccttttttattaaaatgcaaaatgttcttcagaataaaactgtgtaataatttttatacttgggagtgctccttgcacagagctgtcatttgccagtgagagcctccgacggggcaggtactgtgccagggcagctctgaaattatggatattcttatcctcctggttccttcggtgccaatggtaacctaataccagccgcagggagcgccatttctcctaaagggctacaccactgtcaacattatcctggactctgtgtctctctctgttgggtcttgtggcatcacatcaggccaaaattgccagaccaggaccctaagtgtctgatagaggcgatgatcttttccaaagtcagtacttacaaactggcattcttacaggctgcaccatttcctagtatgtctgctttaagcctggttcaacctctcatcgaatattaaatttttctttgtaag

SEQ ID NO: 1955 - DNA, 816 bp, Homo sapiens
tttaagtatttatatttttattccactctaacacctcagagtaaagaactgatgggcaggcatcggcttctgctgacaattgccaaccggcatgagattgctgagctgaggtggactctccagacactggaactggaactccaggcccaatggcctctggtaagaatgctgcaacgtgagacccttgagagagactgacttgttgaagatgaagagaaaaccaagagcctccagtccagttgttgaagagcaaccacgagccaacaccaaggagacaaggaagaagaagtccttctctcaaccgatgtccgcaagcacaaagaagagtcccaagatagcgaagaaaggaaaataactcaagggagagccaggaagaaaaatgctccacaaaaatccatggctttaagaatacttgaggaagggagcaggccaacaccctctggccacagtgaccagctgaatgaggaactctaacagaatgagctgcagttggagcaacagaggggacatagctggaacaacagagcgaggggacacagccggagcaacagagtgggaggatgccaaccatttcaactctctccctgagcagcgagtaatttcagggcaagcccagagactaggatccatctgagaagtcttcagaggtctgacccagagaactcaacaacaggatacgtcccatggtgatgaaaataaaatgaatcttgtgttcaccgttgtattcctcacgacttaagttaaaaacctgatgaaaagtggttaatctccataatgggtgttagctccatcgttttccaacgttagagataaccg

SEQ ID NO: 1956 - DNA, 975 bp, Homo sapiens
gtctatataaaatgtttatttttggaggactgtgtggtctggtgtttgggagggaactccacccccaccaggccaaccatggagctagaaacagagacagcaggaagggcaaagctggccactgcctgctccaccccttcacagcccagagcagaacagggtctgctctactctcaaggtgagtgacagagagccggtactgtttctgcccctggcataccctgagaacccatgtgacttctgtagtgctcagcccctgtgcccttcctgggcctgatccacatgtgtcaacacacacactccctctcacagtctccaaacagcactgcagagcctagctgcatctgccaggttcaaagaggaatttttcacatttgctcacttccaatctccatcttccttcctctgtctcccactctcccactctcagtagccgcatcccagccctgccatactcccttctcagggacaggagactcagtgggcagctggcctcagctctcctaacaggaaaaaaacctgtacagcattagtgccaggtcctgccctcccaagcgctgagcccagaaatttggacaaatgagctgcctcttaactgcaaaaaacaattttaaaaaagcaaaagatcaaacaaacagaccaaaaagcataaataaacagcagctgggccagcaaggaggaaggcagggtgaccctcagtggctccctgtgcccatctcagcctcttgccataaaactcagccatcagtggccaggatgacagcagttccgaagatgcccacactctctccaaggagcttcatctggttccagaactcaacacgccgcgtgttgtgccagtaagcaacattgccatcaatgagcagcatgacagggggcagcagtacagccaggatctgggcagcgagggtcacgtagtagcctgacagaaaggccagggccaggatgccatacagcacgaagaacagctggatc

SEQ ID NO: 1957 - DNA, 716 bp, Homo sapiens
taaaagggaagatgacaacttttattgttattacaaaagcaaatttaatttgtcatttgaataattgcaagagcagactaagggcttaatcctcacacaggcaccaagtcaggcacagtaggtagctacaaatcgtaagaaaaagctttctttcctacctagagcactcttccatgctttggaattaggctaaaaaactcaacaaacctgatcagttccctttaatcctgtttttttttttttttttttaaatgagatctaggtattaacctgctgtctagcgaaaactagtcactaagtcctggcctgagagatacccacatttcctttagaacaaacagaactaatacctgtgtacatttctgagagcctgatgtgtgagtccttaaaatgtagaccttgcaggaggcttagacctcagtttcacctaatgcatgtggaggaaatggaggtgagaatagtcacctgaagagtgcaagcgctccagctccagcacacacactcttccctgggcagcaggaaaaggaggtaacaaggacttgggctgacatctgaagcactaagctaatgtgcctggtagaggggagcctcaggaagcacaagatgtcattccacctgtgctgtccacaaacctgaggtttccacatcgttttaaagggcacagtggcaaatgtgacaaggcagaaaacaataaccatttcaaggatcacttaagg

SEQ ID NO: 1958 - DNA, 939 bp, Homo sapiens
taaagttataaaacaaaatttattatgcaatactttctcataatgaattgcatctctttggtaaaaataaactttataaacattttaataatcagagattagatacaaaaactaagtatttgtaagttgtttttaatatgagcaaagattggcaactgagaagtggttcacttgtgactggtcatctactggcagttataactcaaaccgggacaatttttatgctacatcagaaaagaggataaggaaacagtttgataacaaatttgttgaatcagaaagcattcttacactttcatttaaaaataaataatagttacaatcaattggcaattatacatttttatacactatatgatggcaacataatactttaaaattaagcacttagtttaataagaaatgtacaacgatttaaaaaataagttttgacaatggcactggcagttagatgcaaagcaatatgctttaagaaaaaaaatggcaggtataacattaaaatactcgaattcacctttcaataaatatttttactacatcattaacatactgaagtaaacttggtttaaatcaaagcttacacatttcaaactaaaaaaaaaaaaaaatacaaaaaaacacctgtaagatatatgtaaaccagaaagcctcacagtttcttaggtaaatgctgtgatcttcacaaaagggtgttaagttgttgtagtatttaagacaatggtctttacagctttgtgaagtattcacatctgttgcttaaattgctggcaaaggcctcctggtctaccaagacatatacattccctccttaacacattctctagtttgactttgtgctaaagtatatttaactgaacatctagtatgagccctttacataatgcctcagaaagtagcaaaaagaaaaaaatatatatatactaaactttactatataca

SEQ ID NO: 1959 - DNA, 931 bp, Homo sapiens
tcaatgtatatatctatctttatatacatacacatatatatctatagatatgtatctacaaggaactttcatatattttttgatcctcacagctgtcctatgaggtaggcaggtttcaggtattcacactaatgaggtattttccccataaacactgaaggatgccaagaaaagtttgcattcagatctagtttccatgtattcaaaaaatgaataagagtttaaaaagttgttttaccaactttagtttcagaattgacatcaggcatttcttattttaaaagtccacccttcagagaagataagaaatttctgaagtccacctttggaatcttttgggattcattctgactaagtaacatttttagttgagagaagtgtttctttgttttgctggtgttctttgaggagcaagtagatactgactgtccagatgtaggtgttctgaaaaccgatgctgggctcttgcctttcgagccagacatgtcatgatttgggtttgcagtccttctctctggtgtcttcaggctgagtttacttgtaggagtggcaggattgctcttcaatgttgacacaaagcttctacttttaccatgatgtttcactgttctgttgcatgttttacaagtgatcaacaatacacttttggagtctttgaactttttcaccatttttgcttctttaaaactgagtgtatagtttctcgcttctcgattaagaagtttctgtattttgggtgtcaacctggctttgggtttgagacgcactcgagagttatccagaaccaacagctggaaacagtatggacacgtttcttcaaaagtgctcttatcatcgtgcgacgaagtgtaggcccagaggaggtagcggcttggcccgggcagctgtcgtcagtccccgcgtgcagcctcaaggtagtgcttctgtctca

SEQ ID NO: 1960 - DNA, 962 bp, Homo sapiens
gatgacttcaacttttattgaatgaggtctttattttttaacattacaaactaacactccctttctgaaaaggcagatcttacactcaaagacaatcttcaagcatttttttgttgttgtttaagaaattgagaggggaaatccacagtttattaacaagaagattcaaaacttcattttacagtaataatgggacaacacctaatacatttcacaatcaaaagtggttcaagctaagaatatctagaacagattttaaaatctgggaaagatgacataaactggacaattatcagtattgctcatcacaattttggctctaacagtacaggacaaatgcttgttttgcactgtgcctaagacggccccttcattaaggttcaccaggacacaggcagcatccccgcctcccagtcatttgtacaaatcattaaggcaaatctacaaaggaccagtaaggcactggggcacagcagctgactgcaggaagtctatgtaacttccggtagtaaaacagcctttaatgcagacataggtgtgaaaaattcagtgttttgtttttttttcagtgtcaacctgcacctaaagcacaaaaggtcacttcaagtcacttcaatgtaataaacaattcccattcatcacattaccagtgaaaagagaaataattcactgggctagaaggaattagaagcaggaataaagaaaatgccctttggtttacacttactaaagagaatgtctttaactctccaaggaataccattccgctttgtgaaattataccaattaattaggactcctctatattcccattaatgtcggatcattacataacttcaatagaataaacacttttttcccactttgctataataatagctagggatacctcaacaatataataatggtttaaattatgaccatttctctttggccttgtggtatttaagcttagagaaaaa

SEQ ID NO: 1961 - DNA, 575 bp, Homo sapiens
cagaatccaaaaggactttattttctggcactgggaggcgccctgaggccacagccttttcccagggctgctggcagggtcccagggctgctggcaggggttgtggtcctgttgagcagaggagcgacgccgctgccctggcccccgctgtccctatgatcctgcactctggggtgggagctacatatcatccttggacaccaggcagtagaagtctgtgcgggcactgtagtttcgcgagccgagatccgagacgtccacttcgctgctccggctctctcccagcgagaccccactggtgtgcggtggagctgatggctctccaaaaacaggcccccggacacccaggtcgccctcagggtccgggtccacctctgagtccagggcccggccctcagggactcggcctcgaagaatcagcatggggtccttgtcgtcctgcagctgcgtctgggggtctccttccacaggcctgtactgcaccttccgcggcagcgccagctgcacttctttccaaaaatcggaggaaggagtcacggagccgggcctccagagcagcaaggtcaccaggtggc

SEQ ID NO: 1962 - DNA, 752 bp, Homo sapiens
caaacatgtaatcttttattcagtacactctcaaaacagcatttctgtatctagttccaagctgggtgatcctgcggccccaaaggtagtgatgactctgctgggaggagacacagacctcccagttcagtggatcccgagtgagtcagaaggtgagactggaagcagcagggtccttgagggaagtaggctctccttgaaggataagcaatggctgcatgaagtagcaggtattgaagctagggctttgaaggatgaataggagcttgccaaacaaagaaggtgggacatgcaaaccaagtggagggactgtggcccaaactcagggatacatggatggagtagcaggagaaaaacagactgggggagcaggaagagtcagtgtgagctttctccagatccaaaatcagcagcctgtcattcaaggccaagacattccacaatagttccccttggccctgtcaagcctatcaggcctggagcttcctcaaagcagctctgacaactccagccactgtcatctcccctctttgtgtcacgaggaccatgcactttggtgcatggtgacattcagtgggggctgctttcctcggtgtggctgtgggaccttaggcccatgcctcagtttcccaacctggaaaatgggctgcaggaagccacttttgcaacttatgtttatctcaggccagggaggtcttggacaaatgatgtgaaggaagaagagaaaaatggaagatagggagggagaggaa

SEQ ID NO: 1963 - DNA, 606 bp, Homo sapiens
cagcggtttcaggctttattaacaaacggtgtaaaaaaccagacggatctggaggaagggacagggctgcccgtctcagctctcaaccttcccagagaggggccaggcctggcagccctgtgcgtcgcgcctcctaagcagtcaaccttgtcccctccaaggacaggcatctgacccaatccaggtcccagggaggcggagtcgcaaaccctaactctggggtgtattctgctcggcctcctctccccctccccagatagctctcccagcctggggcacggacagcacagactttgcagacatcacccggggaggtttctcagtgcagacaggagctgaggtaggggttggagaggctgacctcgagaggcccccgagggccaggaaggaaaaggagtcattccactctgagaagctcaaacacaacagacttcacactgctgacgggtggacagaggccaggctcctcccctcggcaggcctctgtttctgggcccagggtggttgaggactcactgagggagagcaggtaaaagaacccgcagacagtaggcgatcatcaggtgctggcgcccctccctcctcccctgcctggctgtcagtctg

SEQ ID NO: 1964 - DNA, 499 bp, Homo sapiens
tttactttgaacattagcattaagttggttaccgtacacatccaaaggcccagcatctcagaaaaatcattaggcggcacacctgtaccagagtctcacaagaataaaatatacaatgctacattgagtggttaaaaatacacaaaaaagtagttttaacaatctataaattttttatacttaaaatcatgattgagttgaaataaaaaagtgcatttcaattgctaaaaaaataatatcggtatagttaacacaagggggaaatcagtacattgagggatctgacaggatgctggaaaaaatgactcagggaagccgggcagcatgggctcctttggagattcaggagcggagctcagttccacctcactgcagttccctggggccaagcagccctcctctccccagtatctttcccatcttaagagatcctgtcctacctacctgtcacctccccaacccaaagactcctctaaacttctttgcagcatgacagctg

SEQ ID NO: 1965 - DNA, 893 bp, Homo sapiens
caagtttaagacaggtttattttattagtttttcctaaacttgtctcatgtttactgaatgattttcttagtgtaagaacgtgacctggagctttaacaaatcagtttggataacgcaacctggataaatgcttgtctgtacacaagccatcaattaccactctctgtcctggcctccatgaaaatccaattggtcttaaagcctgtctaagcagagagcaagcagaccacatcatcgtgtttcaacttgaaattcacccccatcccagcacccacacccttccccacacacacacacacacacaccaaaaaaaaaaaaaaacaacaattttttttttttttaagaagaaatggccattacggtctgggccagttgtaaagggttggcttaatcctgcagccagcacttttaaaatagctactggcttcacagcaggccagctggaactcttgaagcatgacaggtagagaacagaggatgtgctaagaacctggccttgttgtggtgcctcgaggcctccatgcatgcttacacaccaacataagtatactttccccttcctcctcctaagcaattgttctccattgcactttagagcctgtaacactcaaacttttcaatgttatctagagatggacaaacgcttaattctaactatgcaagatagcatcttatttctaacaacataggccaaaagtaacagagaggcactctgttatacagaatatcaatttttacaaagattcaaaacattaccaacaagccctgtaacagtttcttaaagcaggtaccaactctggcctcaaacacagggcttccctcggagtttccaaaatgcctcactcctgtcaacactgccccaaaaagcagtcagaggaatgctttggtatac

SEQ ID NO: 1966 - DNA, 920 bp, Homo sapiens
ggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgttggatcctcctcctttctctggagctgtgcttggggctactctgacactctgtctcttcatcaccagccaaggaaaggggctttcgggtagggcgtagctgcagggcctccttgaagtacttgggaaggaggaagccatcagtattccctggagtcagaatcaccccattggcagagcggaagaagggtattccatctgctgccagagccaggggtccatcgatgaacacagctatttcacaatgggaccgcatgccactgatgataccggggtctccaggcagtcctggggccaggtgaatgtgcgtccttccctggcaggacaggcctttgagtaggatggatggccagtgcttccagaatgtaccatggactagcatcgggggcagggcctgcggtgtctccaggggcatcagctccaacttaggtacc

SEQ ID NO: 1967 - DNA, 854 bp, Homo sapiens
ttgatttatgaagagtgtttaatgtttacaaagagcttttaatgatgtggaagatggtggtataataagtaggaaaaaactggttataaatgatatcacaatatgatgtcaacgatgaaaaaatgcacaaaaaaagacttttttaaaacgtcgaaacatcagagtggtctctagttggaggaataatttttttttttttaagacaaacttcttcatactttttgtacttttaaaatgatttactatgtacatggattacttccataatcaagaaaaaaagtaaaaacttttaaaatgctgtgaacgtggtttccatttttattttctctgatgggtgactgcacatcagcatcttgagttatgctaactacttaggctggtcacgacacacacacacatacagagaagtcacacaggctgtaccgggctggctgttgcaaatgtacatgaattacacgggttgaagttgtttggcagctagttaacatatgccacccaatgacgggacacaatctggtcacacgctgcctctcctgcctgttgctgttctttacaaaggtccgtgtgtcgggctggcaaagtggcatcctgctggcatctctgtggtggccccggaatggtggagtgcccaggtcagcatctactctgggtcccattctcaactgctctggccttgacatcagagcttccggttccctgctggctcttctgcacactggatccatgccagtccaggccccctccaggcacacacctgaggcagactgagagcacaactgacgctgtcctgatgtgaactgtgcccagacacaggatggggggaagcgggagatgtgaccacgacaccacacaca

SEQ ID NO: 1968 - DNA, 1182 bp, Homo sapiens
gataagaatcttcaaaaaaattctatatgcgcactataaatgtttctctgtttgccatttctggtaactatcatgaacacagacagttaactctttcataactgaattggatagctttattttacagaagtatggcaagtttacaaagcaatatctaaatctaattatcattagttgcatttggactaaatgtgatgatatacttttgcaattgattctgtaaataaaaggattacactaaaatatttgtattaaaagaagaaaagataacattttacctttagataactgcacttgtacctcactagagttaatcccacccaatcagattgagaaataaattggggaatgtggaaagagtccaaaagaggtcagaatttggagaggtactggccttctggacaacatttagaccctctacaattattttcattaagctgattcctacatcctgaatattcatgttttctcatctacagatatttgtcttcccccaaactaaaagaaaaaaaaactaccctttactctcttttctactcagttactcttttgtgctatgttagaaacttgaaatatattggtgatgtggggattttgtccctgactgcccactgtacaggacaagagagtacagtgtttcagttggaattcaggactcctggttttgaggtagaggatgatcactgcagtacttggtttggaattgccacaggggtagctaaaccaaaggagggttatatctgcaagggaggtgtaagaaggcaaaataaggaaaaggaggaatgggttttctatttgttcagtttcatcaactaatttatacacttaatacaacttcagtgtcaattgctattaagaaatttttagttgggctgagctggttctcttgtgaaattgtgctggttatctttaagcttatcagttatttgtccaattaaacacttttcaccagtatttagtccgagttgtacagacgatgtatttggattttgtcatggttcatctacagactcaaaacataatcattttaaagtaccttgggagtgtgtagagtaacttctataatagctttatgatcctgatgatgttttttaaacacaataaagttggatcttccatgttacaatcacagaattaaaaccagtatttaaagtggaaaagtattaaaatattatggacaaa

SEQ ID NO: 1969 - DNA, 530 bp, Homo sapiens
ttggaaagttgaatattttattatttacacatataaagtgagaatgaaaattgggcatggggcaagggcaggaagatgactccagctcagtcggtgatgatgagctcgtccaccccccagtcttcatagctcccatctggcaggtaacggcgaatgatgatggggatctttcgggccttgagttccttcatggcaatgagcagaggatctgtctccccctccagctccaccatcacaggggcacacatcgcaatctggagcgctcgggtgcccagcacgcgggctcgctcgtacttggtcatgtatggtgtggtgattcgcttctggttggcctgcggtcgctccccagaggggaggatctcgacattctcctggccttcctcttcggcattctccaagtcatctagcccttcatcctcctccacatcatcaaagtcgtcgccatcaaaattgtcctcgttgtctgacatgacacacctcgcctcagcgacccccgtgcgccccggtcccgccggagaccccaaacagcg

SEQ ID NO: 1970 - DNA, 845 bp, Homo sapiens
aaacagtaattcttcagactttattaaaaaatgacataaagtgcatcttattaaaaaatgtataaaaaccacataaattcagggcccctgtgctgggcagtgttgatatcccttagagtggaggaaggtgagggatggagggtgaactggggactggggagaggaccagggtgcagttagttcctcgtgtttgagttcaaagatggagcgagggtggatatggtgggaaggggcacacgggttctcacgcaacaacggaggaaggcaggcgacagtctcttccctgaattctgagggaaaggcgtacattgtcacgaaatctctcctgagctcgcgctgtcctctcgtgtggccacagcctgatacaggctggaaaggtccaggagttgggtccgagcccaggacctggtgagggccgcagtgccaacctagccctctggtccctgaggtggtgggacgacggcagcaacaactacatcctcggctgactggcaaggcagaacgcacgcagcccaagctggtcctgaatctgcagtgagacagggcagccggtggcagcgggataatgtggaaggtgaagaggccagttggtgagggtttccaactctgtctcagacaaccactttggatgcatccccagcacccctgggaggccatgaactggagcagccgtgtgtgctgcatgccatgctatctcttccctctcattctagtttcacatttggaattgttttttaaacaaagggctcagtttacataaggagcactgttccaccaacctaggcaggcccccatatttggccaggacctctgggccacggctgtttgggtgtctgggtggtagg

SEQ ID NO: 1971 - DNA, 604 bp, Homo sapiens
tatcttttaaaatgtagtctgtattattttcaccaaccaaaacacacataatatattttattataaaacattagcaatgttacttttgagatatgcaatctgaaaggtcacacttgtatttattaccaggaggaaataccagaggagtcacattagaaatcaaccagacagactcgtacgtggttatcgctacttacacagcattaaatgcgggttgaagcagcacccgctccgtgtttcagacacggacttggggtgggcaaggggccctgtaagagggcttcctcctctcagtactggggctctgcgtctcacctgctcccatctccaggcccacggctgacacggtatgcacagccagggtttccagactgctctcctgctctcacagaactctgtctgctctctggactctgcccttgaaactgagacctggacatgggggagacagtcgtttccttcttggctggaaactaagtcaacaaatgaaacaaacctagtctaaattccaggataatagtaaattacctggtttataaaaatacatgtccaaaatagttacttcctgggttgtgtacaatataaattacaaaaataaaataga

SEQ ID NO: 1972 - DNA, 858 bp, Homo sapiens
gagagaacctgaacatttaatatggtcagcaccttgtaaggtgaaggtgtgttttttacacaaattataaataatgaaaaatatgcatttagaaaaagaagcagcagtccccttggcgggccggctcgaggactctttggttgagtggcaggtgaggccctgggtccagggtctgtcagagcccccctaggtcatctgccaggaaggccagcaggtagcggctgacatgtctgtcgatgatgacaggcgagaaaccgaggacgcgccgggtccctggcaggcccttggggtctggcggatagcagtacaggagcagggccagtcccacagcaaggcccaggccagccaggaagctcatgggtcccctgttactcagctcgccgctctggctgcccgagtctagctctgtgcaatctgagttctgcagagcgtggcggctgggcaggcggctgtgcaggggctgggcatggatatacagggctcggtagaactcctggcagtcccgctcaccgctccgctgcaggtggctcaggaggtcacagagccgcacacgcaaggatgccttggggttccggaactcctcagcaccttttccgcctccttgttggtaaggatctgtgggtagtaacggttcagctggaggatgatcctgtccacctgctgctcactcaagcgcccatggcctgtcaggaaaggcgtgtcctgcaccaggcggtcacaataggtctgatctgtcatggcgacggacacagcgccgcccgcagtccccagcggtctgccccgccgcggtccgcccctcggtcagccgcccggtccaccagctccagcgaacgccgcccgcggccgtgctcgcccgcc

SEQ ID NO: 1973 - DNA, 1418 bp, Homo sapiens
gatgtttcaaaaattatttttattgttacattccaaagaggacagaggaagaaaaaagccagttatccaataatggttagacctttcagaagaggcacccacaaccccagccctagttcaaagctgcacacattggagctcaaacagctgcctctcaccacgaccggaaatgctgacaaatgtgtatatattatcaatccagggaggcttgggtttaaaataaaatttctttattgcaagtgtccaagtccttaggatttgtccttaaaggtactagaagatgagtaagaccacacacaccaagactatgtttagtctttagagtaaactagcaaatggccagtttgttctaggatgcattgcatcagacatcacagtacatgaagaaaatctgctttttgtgaaaagccaccaggcattttagatcccgtttaccatgaagtgcagacacagcagatacccagataatacagtcagtgcaaaagtcaaatgagtaagtcagctctttgatgaggctggctacactgcaaaatataaatgaaactcgaaaatagaaggtaaggtctatttacaaaagtttgtttagtaaagtgacttgaaaaaagttgttaaccacttcccaggcatccctcccctctcccaccaaaacaaacaaacaaaaaacaacaacaacaaaaaccctgaaaattatcttgaaagtcaagttaaaactatgtgggtgaaaagagagtgcttgttccaggtaaaggacttcaagataatttacaggcagatttatttttattagtaaaagtcacaaataggaaaagacttattggctgactttgagctgtgtgcttttaaaaatgtctctattattacgttaacaagaaaaaaaaatcaagcaagtttttgcttccagttttgaatcttccagcaacagttggtgaaatcaacaaggtattaaaatgaaacccagcaaaacccagtcagttctttccagttgtctgcctgtttctttctagtcaccttgaattcaattcccaattagctgaggacaacatgccggtcaaagacagactttcgctgctcttggacttgaagcttccagcgctgctgtgcatattctaccttgttcagcacgttggctcgactgcgggagcgggctcagcacatcgtgtgcatttgcaaaaggctggtgatccccaatatcatcatcactctgtatcaactgtgcatgtccaaagaggcgcctcttcagtatgggctcaaccagagtaagatataccatgtacagaagtagaaggcccaaaatggagagataaattataatggtaaccttgattgtgacagagcttctttcttcatatttgcattcacagcgtagacagtatgcctctacatcaggcccccgcacaggcatgggctccacaacatga

SEQ ID NO: 1974 - DNA, 1161 bp, Homo sapiens
tcatacacaagccggtgatactttattatataagagagttgtcaaaaggacagtttcatttctgtttcagaatccccacattccagtgatccatctgttgacacaattaacataaactatttgctgatatttactgagtgcttgcaatgtatcagagtcattaaataagatgcaacttctactgtgaaaactggaatcttcattaggacacagacttagaaaaggcccagtttcaaggattctgacttgcacagactgagcactcccatttccagaagttcgaatacctcctttcttatctcgggaatgtccatcattctcctcaacttctgatctctccagttccagtcaaaaaccagaaattttaaggggctcaaattaaggccaccttgtttaacaagttctttaattctccccggagttcctacacccaggtgcaccacacgcttctccagcaactttacctgcgcctggacctttatgtgctttgcaaataattttataactttgccgtctcctctgaatgctgtcatcgacctaatgagctccagggctcggacggccgagctgcagatgatcagcatcaggaccgatttcttctcactgtggttcttcctaagttttacccacttaggacaaatttcttttaggtatgaggaaagactgtgagtcaaatcattggccttgaggaaacaggagtctggcaggttcagttcttctaattcaatcaccaagcgtctgctgctataatagtccttcatcagcttctgtaggtcttcaggtaaccctggttttggttctgattttgcaagaacatcagtaattttcttctttcttcttttcctggtcttggtggtattctcttttctttcctttggttgtatcaaaaaacattctttaggctgtttggttttctctgaaggtacaggaactggaactgtctcctgctgcatcacttctgtgtctccttctccttcaccatctgatgcttctgggctgctgcctgctccagtcggctggttctcccaccactcgtctccgagatcgtctgccatttcagctcaggtctcgacgtgggcagaacatcacgggtaggcgaccagctgcggagaatcacgttgtctcaaagccaggcggccggcgtagctacacgcggagctc

SEQ ID NO: 1975 - DNA, 835 bp, Homo sapiens
ctgaatattttattagggcaaaacaagatatttgcatgggatgcttcttaagtcatctcaagtagttccccttcagttcttaacatgcactctcaaaatcaacacacctaccccaacccaatactcatcgcttcacagtcatccagtaaagtacaaaataaaaataaaaaaatcatcatctggcaaaaaagggaaacagggtaagagagagtgacattttaacacattactaaaatgtttaagcttttatttacacatccccttctctcagtttcccaggttatatgaacattacagcaatagaaaggggttatcatcacagcatccccttgcaaattccagtttacaggtaacttggtcaggggaaaaatatgggtcaacgaagtaagatctcagctctcccataagctattgctctcttcttctctttcccccttctcttaatgttagctgcctgttacagagagggatcatcaagactgtgtggacatgctagctgaattgacagggtgggttccagtgtcctgtgaagaaccagcaaggatgctttttataattccaaccattggcttcacatcactgaggtaacaagacttaatgttaagggtaaagacaccacgccaccctagtcagtgacatgtactccactttccaggaagacctgggccaaatgaccaagctttgcaaaagaaacctgggaagagcgttggaaaaagcagactctgagttggcttgagtctcctcgtgcatagaagcattcactcatccatgcagatggcaacaaggcaggacactcagaaagcataagatcaaggtactgctcttatctgcacct

SEQ ID NO: 1976 - DNA, 1153 bp, Homo sapiens
aatgcacggtgaaaaatacattttaatccaaaagttttgaatattggcacttagaaagttatttacaatcaattttactataccctttgtgaataaagagataattatgtacgtgtagctacctatagttgtttctttccaactcaaacaccataactatgtggaaaaagggtaagagttaaagctgctgcagctcaaaatcattacaatcaacttagattctgcaaattttcccagggttgaaaaatgctggttaaatcaggacaaaagaggaggcaagtgagtacaccccactcctctcccattttacgtgttgctcccttacttaaccggcaaagacctgcacctgaattctagacaatttcatatacaacaggcctcttattatgggtccatagcagatggtttagggtagatgttttaaagatatcaatgctaatggcctaccaatgactttcatgacctcccaatattcgttttaatggtagtcaagagactatcaagcaggaagcctgatctcgacatgtttcctctgcggctttggtgaagctgactatctgcagtataaaatcttatggtttgatcgaagtctcatttttgactagaaacagtaaagagcagctttattaagatcaatggaatggttctgaatgcctgtttctacagaaggattaaattaaaattttttcttttttttcttttttgagacagtcttgctctatcacccaggctggagtgcagtggcacgatctcggcttactgcaatctccacctcccgagttcaagcaattctcctgcctcagcctcccgagtagctgggattacaggcatgcaccataacacccaactaatttttgtatatttagtagagacagggtttcatcatgttggccaggctggtcctgaactcctgacctcaagtgatccatccactcaggcctcccaaagtgccgggattacaggcatgagcaccgcacgtggcctagatgaaagtttttaaaagcctgggctaataaaatcatccaccaatcatttttcttatggttaaagcagccaaaaagctgtcacagcatttttgagatgagaacataaggcttgtgtggctttatgatagatgctgttagtcattttatttgattaagcccttggtcag

SEQ ID NO: 1977 - DNA, 1359 bp, Homo sapiens
aaaggcaaaaaagtaactttattgactgctaatcttaccatgaaatatctataagaaataattacaaaataatgcaggtttctttttacatacttttggtatcatcttgatatgatgatcctttcacagaaaggattatttacagtttatgtagatataaagctcactgttgcatatacaaatgtagatgtgcagaggcaatatataccaaaacgggtatactgacaagcgatagatatgtaagaaatgcagaataaataacagctttatatatttcctttcctttttatttttaaaaacaatttccaaatacaaaacatggattattcaaagtggatttttcctatacatatatataattctgctgcaaacagtggatcaaaaagcagaagtgttcttagcatgattcatctttgaaaacccatagaactattcataaatccaattagaaagaacatgtgcaaaaccaccaacaatgtcagcaaaacctcaaagatctgattttggttgaagtagagagaaaataaacataaagcagtacctgtttacagtaattaaatatgttttttctttatctttctttcttaaatatgtctttttttaaatgtttgcaagaaactctaagggctaaggaaatgcactgcattatgatctgggctccttagagtacaaacctcaccaggcttaagcatcatccataagaaatggtggattacttaatgacttataagtaaaacagtcattaaatgatcctttcatactttaatcctcttatgcagagactgagatacttccatacattccaatatctgcaactttggttctattaaagtatttgataaaagcaaaacaattttgtgaccacagaactctatggaactttttttccttttaaagtgtcaggtgaacctagcgtgataaggcaatgttgcctacacatccgcgacccagcacaggagggacagcacagacagggcatgttccagctcaccatttgttgtataatactgactcccagccaggggtaacactgcttatgttccactgtaccctacatctatttcgttacctgaaaacataattttgtataaaaatatgattgtttctttagaaaataatatatagtttttttaataaaactgggcagatagaaaaaaatggtatatcaaaatatggtaaacaaatgttgtaaaatactaaatcattaaaaatatcttatagaaagacattgtgctatgaagttctctcctgaagtgtgaactacgtttttactttacatcaaaagattgataaattcactcccctgacttggtttcattatatattgtaacagcagcacaacaggtaactgtcttaaaa

SEQ ID NO: 1978 - DNA, 1389 bp, Homo sapiens
tgaaaggtaagtaccattttatttagtgttgtaggaaatgttgggttacttcttaaaaacgaaaccaaagaaattcaaaagtcccaaagaaagaaagcaggaaataataattctataatccaaaaacgttgggcgatccttcagttggaggaagagggcgtcagttaagtagctcacacagtagatatggagacaccatatggagatacggagttaagtttggtggatactaggaattaagttctccacctaaggcaattaatttttcagccttgagagataattagtagttctagaaaaagaaaaaaagttgactgggagaagggtgggagggaggatggtgcgtcatttaacattaaattgcctctctctacagtatgtggctgagcatcatggaccttcctccctctgccccgttgagctcccactgttagcaaaactgagaagcacatgcctgtgtcttcttcataccggcatgtgcacacacacctgtatctccttcatacaggcatatgcagagccctcaccaatcggggtccacagctgttcagtatggcaaagggcagacttactccttcatccactctgctgccttgatgaggtgaacacactggaataagatggagggcaggatacctgccaaagcctgaggaatgagatgatctgaaacaattgggcaaaggctggacatttcaaaaagctgacttccaactgcagtttatgggtatagaatttgatgcttccctcaagtcctgactgctctttctgaggcagccaggctaggccaagaaatgagctgctccagcttctccagagcacagcagcctcccagggcctgtcagaatctgcagcagctggaaggaggtcccagctcttctgagacataggccatttgtaggattctccagtgctccaattcactaatgtctcctaatggctcagaacaggctaaagcttctcccagataacccctcccccaaaactgagtcctcagggacagttgttaactgaatgacctccaggttatctactttgggaggtgcaggaatgctataaactgaattttttcccagcagcagcagaagccaggcacccttgagtcaattgtccttcattgtccagagctaccaagtggcatttcagagcacaggaatttactcctccacccagatgtccctctcatatggactgagtcacacaccccaggtcctagcagcagacatctccaaaccaacatccttgtgaacactgcagatctctacgccagctctccaatggaagaagaaccacatagagcacacctcgcccccagggcacttggactatcacagtaaaaatacatttatatcaagtaaaaaacataatgcaggacaaatatatacatgtacc

SEQ ID NO: 1979 - DNA, 1365 bp, Homo sapiens
tttaaagatcataatgctatcatttattgaagaaagaaagcaaaaaaaactaacaattgtgatgggggaggagagacagcttggcaacattccttttaaagttaagttagcataaagaaaacaatatttagtaaatgaaatagattttcaaggtaggaaaagtagtactcaagaatgtatttttggatacaaaaattcagttacacaatcagtagcattcaaaattagttatgagtatttatacaattacaaaaatggattcatgttttaacaacgtattttaaaagctcaaacattttaaaacaggcacaatattctaaaggcatatgcattcaccatgggcttttgaatgtcctcactcccaacttcacaatcaaaatctacagaagcggcaaaagatcagagttcagagggctattttttttttccctttccttacttaaggttgcaaacacattgacagaggcaaaataaacacgtttcatagcagaaagaccaaaaaattgaatgtaaaccatagctctcccttgggagattacacaaatacaaggttcatctgtacttagaacaaggctcataacttcttgtagcatggacattcaacaggcacagagcaacaacattcacccaaataccagctgcaatttgtcctttaaggatgcctcacaaggatattatgtccaggtagctagtccatttatatcggggaccagttgtccttttgttgtttgtggctgtttattaaatgtagtggcacaactttgttgtgaatatgtaccatcatttgctacaatctagacagatcatcctgtctacaaaaaatcattttctacatttctaagaccattatcagtttatctgctcctgctagaaaaggacatactttttgtcaatttacattaacaaaggctctgctactccccatttactcgctgcaatgaaaactggtaagccaagggtaaagcttaagtatcagggactatgaatttagggtagaagtgaaaataaccaaagtggaactaaatcccctattctggagtgcaactgagatcaagtaaacttcgctggactttcttcttaactataaaactattaaccagaaggtaaagtcacacaattttacctcccaacaaacttttaaaataaaaatttccaaaaaatttagatgtctaggttttgttatatcttaccaagagttacacagacataaatttgtatttaacttcagttaaacatctattcactttttaaaaatgctgtctgcaaataaactactggacatcttaagcttactaaaaaaaacttaagatttttaaattaaaaaaaaaaaaactaggacaaaaatctagcaaatggtttccctcg

SEQ ID NO: 1980 - DNA, 645 bp, Homo sapiens
aggttaaattacttcgaaactttaattacagatacttttccacgcaacatttctgaaatgaaagctttgattctcccctttttttgcataaaggctgggaaggtggtttggccagaccgtacatctttttgtatatacatatctacacctgtgtctcttctttattaataaaaggtgtcttgatcacagtcccaaaccaactctgcattggattccagcatataaaactcagagagtaaaacaatttcaaaggaagacaggctgcaaccacaggaaaatggcaggaaaagttgtagcttgatagttgtttcttctaagtttaactcagaaatataataataattaagagaaaaaaataagaggccctagctttcatccctgctaccaaacacgctcgtccagaactctaggctgtcttaaagtgcaattactgttgtgaagttgctcaggccagggatcaggctggacggagttcaaagcagaaacttcaaacactccttgctgttcatgactcaggggctgggagggagggagaggagaaaaagaaggacagttctctggcattcaagtgcatcaaaagaataaatgtcttttcttttggtaaagcaaatctgtcaatagtaaggaatcctggtttggaaaaat

SEQ ID NO: 1981 - DNA, 1077 bp, Homo sapiens
gcatcagagagcttcccatttgcatctagaccttgaatttatatttattgatcaagttctaatttgtatgtatattttgtgcatattcaccaataacagttaaaattaattatgtgttatagttaatatatgcacctaccttcttccgttagtgcatcagtaaatgtgttattttgtcatttttccaaagagagtgttgtaggttttccctgtagttcttcctttatagcttttcttctgataaccatgacttcaggagctttaaaactatctatcttgcatttgtgtctggcggagaactagccattagcctcctgaagcctgccatcattgttaatttgaggactgggctgtcttggggctcagaaggtaaagaactatttgagcagatgtgtgtgggtggcactggattccacccaactgccaagttagtattgttagagatttcattttacaacacaaaaataagcctgtgtcaaagattttaaaatcatggaaagttaaaatctagaaagaccttagagaaccagccaaccaactctctcattttaaaagtgaaggattcatagcacagattacttgcctaagatcatccaggaacgaagacaagaatccaaatgtacttggggacaagaattagtccccaaattcagtgttcttcctagtattaaacattgcccctttcgacaaattttggatttcattcttgttatatttcagtactcttgctgatttattttaggtttaactggtaaagaatgaacatttcagaagtgttaggattagtcagtgtcatcgcttatgtatatgaatcacttgccaaagacactggctctcctcagctgtaaccagcatgtcaaatgtgaagattattgtgtgggatcctttggtttcattgttatgatgtattttataaatgtactagttatatccttgtttatgtatttttgctgatctttcataaagcagaatggtatgtatcggattgttttaatgttatatattggattgtattcgatgttacaaaaccaatattctatggagaatgaaaaaaataaaggactaaattaactggaa

SEQ ID NO: 1982 - DNA, 992 bp, Homo sapiens
cattttgaaaaatgtttatttaccttaccttttcttggccaagtcaattgctttggtcatctgcacaaagattctaaacactggctttcagcatttctttttccaagcaaatgaaatttatcataacaagacagagctctgattttagtctctgtggagtctgggctctgatgacctaggctagtcatcatctaagcctggaatgactgtttgggacccccatggccagcttgaagctttccttcctcagccactctgggcccctgaagaggtcacatgcatctgtggcagagactgtattataacaaagttgtttaccccaaagtcagcaaacacatgtacctagaactcatcccaattgtaggttgctcaccagacaggttacacgatgtgcaccagttaacatgccataggaaaattacattccaagaaaaagcaaaatgctataaaaacaaaaaaaacaaaacacccaaaacagctctccctcctttgatctgatggtctgcagaggtcctcaaatccacacactgccactcttcaagaccaaccactgggccttcttaatctcatccaaagtcgcattcacaactttgacaggagcttgggttcttcatgtggcagctgcaaccatgtagtgtcttctcacttgcagaactctaacctcaagtctctcatgagtcccaaaattccaggaagcataaaaaaacagcaaagcacacgagtatacttccaaactttgaaaatacaataagatcacaggaacaaatatgaccacaaagcagcgtacgtactgtataggccatattcctttacgtgggacattaatgaaaagctgtcttttccaaactgaatgcgcctattaataaaaaaatacacctgaccatctaatgctgaagtcatccgccaggatggtactggaaattgagtggctaatgtggagaaaacgcaggcagaaaaacaggggagacaaaacgaaaggctctcttggtttg

SEQ ID NO: 1983 - DNA, 1155 bp, Homo sapiens
agtatttataatcatttacttgtagcgaactgtttaaagttaacacttgtttaaatttttttacactatagcatttatgcaatggtttacagaattcatggagttatttttatcagtatgggaattaattaaaaccttgaatctttgttttgtctgcttctctgagcacaagcctggtcagctggtccctgcgggtcctaccagccagcttctctgtagggctctcggccgcgtccacctctgctctcccaccacaaggtcacaaactcccacgcagtcctgggtcaccccgcagctgctctggagacttggctctgggcgtctcgtggcccaagtgctccaagttggaagtttctgtgggcctcgtgtaggggatgccgtgctgggtgagcaaacctttcagccttttgatctcctttgagagttctttatgagccttcctgcagttttccagggtctcaaaccccaagctgtcaggacctccctccagctgggtgggttcattttcttctggggtctttaagtagccagcatcctcaaaaagtgtcctcagcaacttctcatggccctggggggtgatcagctcatcggccaggtcctgctctacctggtcccactgccgctgcaggcctctggcagggttgggtacactagcaaggcgtgggggtggcagacgaggggggtctcgaacgtcagcgcgtagacgcaggtgctcggctcggacacatgggccagccggttgctttttccacacgccagctccaccttgctctgccggctccgggaacggcaggcgtcaccgtccctcatccacatgcccgtgaaggtgttgttggcgatctcccactcgtgccagatgccgaggatcacactgtaggcgttccagcggaaggtctgctcgtgctgggtcacgttgtggaacgggcagaactcatacttgtacgtggactccaccaggctgaagcacttgcccgagagtcggaagagatgcacgggtccagacacgggtgaaggatccctcttggcctggaggcgactggcctgaggcaagaacgggttgttcaccccaaacgcgttgggctcctccaccaccttcatcttcgctgcacctgccggcgcgggcccgccggccaagagcccgaggagcaacaggag

SEQ ID NO: 1984 - DNA, 1081 bp, Homo sapiens
aagtttcaacctttttattcaaagcagcttctcacaatgtataaatactgcatattagcacacatgaaaaatacaacttctaaggcacccagaaatgtgttcatacacgttacaggaccattcacaaagagagtgtacaatttgctctagacagtcaggatttgataaatcagaagattattatccctcagtactgcacccagtctcagtaaatatttacaacatggtgagaaggggtcagctgtaccttctttataattctatgaagtactcagacttacaaatattcagaactagttaaagactctcccatgataatctggcaaaataaaacaagtagcctaattttgcaaaggtctcggtggattttggtgtatgctacatccatgatcaaatccaaacactcctagggtgggctggataagtttttggtagcctgcttcattatcggaagtttggtaataagccttaccaatagaataccacttcttcagcatcaatcatttctcaactggtcaatggatcaatgattccatcatgaatgagaatggagagagaactgaagacaattcttctcacacctaacaggaattagaatgggtcaatgaagaacaaaaggaggcagacatttggaaagtgcaggatcctactgttcagtatagacatgtctgaaaaattcttaccctggaggttcatattcagatggaggagtctacactggccagataacctggaggagtaccaggcctccacttttatgatatggatacaggcttgggactacacagtagaaacaccaacctgagatagtgagcttcaattagaaactcatctttcagagccttttcaatatgacaacgaatccctctgtatggccagccagggggagcatgaggttggtggaagtcagcagtttctctgcaccatcaagcatgcacatatctgtctagatgtgcccacaatctatgaaactcaggctttgttagaataatggaattctttggttctcggttttatgaaaggcaatattgtcacaatcctgtcaacatcgacactggcaaatgacttcaagctgggacta

SEQ ID NO: 1985 - DNA, 631 bp, Homo sapiens
gccacctagagatgataatttattgttttaccatgactcagaagagaaacaacataaagagaatatttcaaatccccacaatttccttcctcaacctcactactcttaacatttctttatcagacgccactggcttcctaaaatggaccactgactatgtatgtgtacacatttcattatgctgccttttctcttatgattaaaactttagccctcattcgaggtttccaatggttacttttagtggaggagttccctagcttttaaaaaaccacttttcctctaagattccattatttattgaaagaagtctttctagaaatgttaaggaggattttaaatgaacacattcaattaaaaaaaaaatcacgtattgaacatctaccaagcatctggactcttcggaacctagtaaaatgaaaaaatccagttttaacaacagtaacttcattctgcgggtatacagagacaagcacgtttcttcttttggtctaatttattctaaacgaagaagctgggaactgacaaaacaggacaggttgtttttaatccagtctacaaataaacaagacaatgcctgagttagccctctatatagatttaggcttatgctgacctcgttgtaaaatct

SEQ ID NO: 1986 - DNA, 608 bp, Homo sapiens
gctttttaaaatttattttaaaacatgaaacccaagctgaatagaaaccacagaaattacattgacgagatttttagtatttgccaagaaaaaaagcccccaaagaaataaaaatcagcccccaaacccagttctaaaaaaacaaaaaaacacagcgacagtacatacagccatggccctacagaggctggaggagggggaaatgcaaaatggttcaggcctcagttcctggatgttaaatcacactggggtgggggaggtcagatgcccaggccgggggggtaaaccaggaggctgagtcttaaggagattatatatatatatattatatataacaaatatgaagtggttcagtacacaaccattatggttaaacacaaaacaaagatcccacaggagaggccctggtcccccgcctgcccccttgtctggggttctggggtccagggggctgcctcaccacccctctcagggctggggcagagctggccccagggcaggagcaaatgttgcttggaactcgaattgcatagtgagatgggtgggtgggcaatgggccaggggctgctcccaaccaggcccattcactaccaaccttgccatgacat

SEQ ID NO: 1987 - DNA, 785 bp, Homo sapiens
agtgtaaacattcacatatttaatagtacctttaaaataagcattactacatttaaaatggttccaaaatgaatctataaatggtaatataaattaaaaaatacgaacttaaagtgaataaatttttaaccttagctatggtataaataatggtaaatgtatagtgtacctttgagtcattaaaatgtcttaaaagataacagcttgttaccagaacattagaaaccatagccatgattctcaagcgttaacaatctacatttgatattttcttggccactgcattcttcaatgaataataatttccagaattccattccatgttgttttccaatagatcttttcacactcgatgttgaatacatggctctttgcagatgaataaaacaagtgcattcagtttagagatccattttgcgaaggctcattcgactgaaggaatctctgtggcaggtgacaggcaatactgccttgtataactgagggatctttctgttgatcagtggctgtagggcctctttaaggcgatgatagtttctctccagttccctttgatactccttttgatccggcccaattaagctcttattttttcttaaggcatcttcacaccttttagtaaaatctttaaagcagagtcgcagtttattatgatgtctgaagagctttgggtcactaggtatttcagacagaaaaacctgggcaacttccaaaggcccctgattcactgtggtgcctacagatccctggagtaccatctgaagcattttggggtctgcgggatc

SEQ ID NO: 1988 - DNA, 622 bp, Homo sapiens
  Modified_base 546: n = a,c,g, or t
ttagtttcaatagcatattttattttaatctaagaacaatgattaaattcaaaggtcagaaatataaaagattatccaaaaagtttaggatcataactgtttcttaaacaacattggcatgtacttgagctggttctgtggctccaaaggcttgatttttaccttgcacagtttaaataagcaagaagccttacgcgatgctccacaagcatcacaacatcacaaaatcattctacaaggcatgtctcaggggatttggggccatgaagatctttttccaaccaaaagtctgagccgagatagaatcacagcttgaagttcctgctctcagactgtcctccaaatggttccttaagacactgggtgccctgagctctggggcccaggcctgagggtggcagctggttatgcacgcagaccagttctgttggtcactgtgtgggcattccactcctatccttctctgccagtgccactcggatgaatttcccattggcaagttctcgtacccttgatgcattcagaaaagcagaaaggaaccgtggngaccctcaggcacctccccccggctgccaacaccagccccggggacccacgtatccggctgtaccttcagtaagga

SEQ ID NO: 1989 - DNA, 1170 bp, Homo sapiens
aatgtttcaacaacatttatacatctttttaattagattagctttacaagcaacttgagagctctttcataatgaaacactgcttttcaaattacatgactttatagtctatctgtatatgaatcctgaaaatctttgcctactcttgataaaggtctgtgttttacagctggttaatgtgttgaataaaaacagcattatgaagctttatctttaaccaggattaaacacatataggccacaaacagttttaaattttgtttgaaatagagtcctgcttggtgacaagttaatagtcccactaacatgaaatgaatggatattaaataaatggccatcctgatttcttgatcttttcacaatgattcctaagagagtatataaacttttccaaaaaatatacaatttaagacctgtctggcaagcacaacccacagatagtagaatctaatactttttacaactgtagaggtacacatttgaatgacaacaggggctcccaaattaaaaggctgtggctgtacattttgacaatcaaacaaacctcccatcaacataaaacaatttctactaaccctaaaaaagataatgcttttgagttgtggcctaacgccgcgcactgtactatagaccagatggcaaagacaacttgcgctcctgggttgggctggcagaggcacttactgtagagatgtgatgttatcatctggaaggaaggggaggaagtagaacaaaactgaatatgggcgaggaaaaaacaataaactatcactttctcctgcaaattctcctaagtgagatcactatactgaacattcaatcccatcctaagtccactgttggcttcactacacaattttttttccatgttttacatgaatagcaatggcaatcttttaataaaaattactgagcttcccatagaaaaggtctcaaattgaatacaaactatacagatgctaaaaatgtcttaagttgaaatatacagaaaatttctgtatactcacattttggcaaagaagatcaaggacagagatagaaaacctaagtgggcaaggtcttacacccataattcacgcaaaatatggataccaccctttaggttttgctaaaaagcctaggaaagtgaagtctaagacatccgtcccaattcattctttcctcgtgccg

SEQ ID NO: 1990 - DNA, 874 bp, Homo sapiens
ttaggattttactttagttttaattgacgttttgctcaaaagcaaagaactgaacatttcaatggttcaatgttacaagattacaaacaaaatccttacacagttacagtatcctacttcggttacttcacattaaatgcaggttgttaaaatcagtgctgtgcttgaacacaagataagcatttcaatttaataacaaaattaaatctagcaccttgaaataaatattgacgacagctttataagtatgaaagtatcatttcaataggaggaaaaaatccagttcaccaacagtggaaactaatagcagcattttcaaagctgagatgaaatttgtgtaaacacacactggcccgcacagtggacatgcacttctgttggctgggcctccccacccagggatgaacagagtgcccactgagccttttacattccaaatctggaaagctgcctcaagtttcagaccgtgggctagaaagactcaaatgcagggcaagggagatcaatgtgtttaagcaggatggggtcctttttgtaacaggccaacctagtaacatttccagtccaacttcagagcattccaggccaaaggtgcatatagtaacaggtctacctgatgtgaccctgacttcagggggagcacctgagtgcagggcaggatgcaggtgaggaacgagggcccaagatccccacagctgacaccactttgcaaccagcgcattctaggctaactcaggtgagattaaaaaaaaaaatctgtgattcttaacccactgtaaccaaatggttcttaaatagggaatgtctgcatggtaagtctccttcttaataacattttcaagcattaatgatgagttctttacagtgtggttct

SEQ ID NO: 1991 - DNA, 1055 bp, Homo sapiens
caaatacaagactttgtttattaataaagtaattcattatgacttttgaaaaaaaaagttttaaaatgttctgtgtacatgtcaatgtaggttaggccagccaaaagacaaagcaaagcatcaacattaagtcacaggctaggattatacaaataagaacaaacacaaggcttatggtacttgttaggtaaacacaaccaaactaaactgtacttcaaatttgtttatataaaagcatattaaagctcactttaaaatagtgtccatcttttcttttaaacgggcatagactcatttgcagtcatgtacaaatatacctaatagctttcttcatcttttaatacaagtacaattccttgcttctttatgcaacctaacaaaataatatagaatgaagtcattagaaaaatatgaacctttctgaatctatattacatttttaatttaaattggaaaatacagtttagatcatatgaaacatatggatttcagacatgtattatctgtttctaacagattattacaggcggtctttattttggctgaaatgcaaaaatatgactttcttaataacagattagttaaaaatactttccattgatagcagtgctagtccctagaacaaaaggtaagcaaaacttatttgtaagttactgcctattcaatgcccagaatatgtagatcctaaatctaagcccttaatatacatctactttaaagataactgaaagatctcacatgcctgataatccttaatttaaaccgtcctgtaaacatagtcaaaatctgctaatagaaatacaattcaagtaaacattgcatatttgatttaaaccaccttacagttaaattcactcatgacacattggatcataaccactaatatgtaaaaagttttaaaaaaatcatccttacgtatagatgaaaataaactttgtaaacttgttcatttaaaataacgaatgtactgcagctgctcttgtggtttggcatagtttcaggtactgaatattcaagtaaatttgttcccaggtaaaccaagtctcctaatttgt

SEQ ID NO: 1992 - DNA, 1530 bp, Homo sapiens
atactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccgttggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagtgtgtcatttccctgggatgagggaacaaagatcaggttccaagagtaaccttaggacgctctgggaagagaaccgggtcctttggggtgtctgggagctgcccacccatctcctctgccagaccggcggtcagatagcctccctctacaacaggctggccctggggcgcagggttattggggttccaggaacacagcctgatgatgcctccttacgatccaggatggagagcagcccccccaggagtatggggagggtcactgtggcacgggcttctccatgacctgggacatgacctgggacacatagtcaagagcacggttatcagcaatacagatattaataaaaggcagacgaagtcaggaggtcagcaactttgcgggcttaccaggaggcctgtcctgcctctggaagccagcgacagagagggatgcccccgacccagccagccggagaaagggatggggtggtcacgaaggtctgagctgggtctgggtgtaggctgggaagcaggctggggtgtagactgcgaaggcggccctgccgggacttctttccagtccccggcgacctcttcgaattctctgctatctctggggagcctcgggtgggagggggtgtaagagacgcagggacgtggggagaggagacaaggcaggcaagaaccacaggggacggcggacagacgggcgacatcctgcggaggacgccgtcagtaccaggaagtgcaggcgatgaggaagcgcacgtcgtccagcggcccccacgggctgggctcgggctggggctggggctggggctggggctggggctggggcggatgccggggctgttccgggccctccggcgccgcaggctggggctggggctggggctgggtttgcg

SEQ ID NO: 1993 - DNA, 724 bp, Homo sapiens
tctgaagaagcatttattagcatgcagggcccatgctagaggctccttatttccagggcaaggccagcgagacagagcccattgctcaggacgcagcccagattgcaaagagaggacagcccatggtagcggaagaaattctggcggagagcactgtacttggggtccttctctcgcagctggcggtagggatcgggaccctggtggctgcctggtacctccccacccaggcctcgctccttctccacggtttgcagggcccacatggcagctgtggtgcggggttccagccagcgggcgttgacagtggccagcgtaaggctcaggaacagcaggtaaagctggctggcctcccagaatgtgagctgagcccaagcatgctgtgaagccaagatgcagaggttgatgaaggcacagcccatggagatgtggaagtagaaggggaagagtttgctctgcactagtccgaaggtatgtcggggaaggcttcggaaaagcaggaagcctgagacgaaggtcacccacatttgcatgccccaggcacctgacaagaccagtagatggaccatcttaatcaggcctcctaggttcccgccttcctccatcttgcagtccgttaggaaccgggacctcaatccgcagcacccggattccgagaacagaggcgtcggggccaaatgggctgaatctggtacctcactcccacgcccccggtgggacagcg

SEQ ID NO: 1994 - DNA, 785 bp, Homo sapiens
gagctttggacaaatttattgaaacatacaggcggctgttagcagagaaatcattccatgattgatgtgttacatttggccactaccttgaatgtataatttaaaaattatatttttcacaactaagcctttggccaaaaaagtcatttagcacatctttaaagatcaataagaaatggattttggacattaaaaagatcaagtcactgaattaaacagtagcaacccccattaatctagaatcccatagtgctgaaggtagaggtgtctgtgcaaagctagtcatttgttaacagcaatcagaagagatgggggcaggcacacctgtcagaggtggcagcagagctggcaggacaggacggctgggctggtctggtcaggtgagcatgtcccagagacagcagcaacagagagccgtccagcaggctgtgaggcaggtggatggtcctagctcatctcttctttggtcttctaccacatacactgtggttttaggaggctcctgaggtccaccctgccagccgtactgtgggtatccttggtaggggtacccttgaggaggtgggtagggtccccccataggtcctggacccattggttgtggtggataaggtgggtatggggccgttggaccagggcctggatatggtggagggttctcttggttcatcggggacctgtaaagtgcacctctcctctccacgaaccgactggataacggtcgggtctgaacctgaggagcccggaccagcccgcagtagacttgccgcacctgtctcagattg

SEQ ID NO: 1995 - DNA, 819 bp, Homo sapiens
aaattgaatttatactttattaaaatcaaacaatacaagccttaaaatttgattcaataacattataaaactatgcatcctttatgaagtttcagttgatatctgattaaaaaacactttgtttcataagtgttcagtgatttatgaaacttttaaaacaaattaagatgggatttattacatcttatagccattattggacccattctacattttgaaagactaagagaatagggttagctatgggaaatgctggctcactggaagaatcctgcattttccaacttccccactcctagaagttttgctaacaggaattgcaactaggaatgcctcacctgaaaaactaatttcatacaactttcattaagtagtttgacaatctgtgacccacaaatacttccatagaatggtagaattatttataatcagaaatgatggtggggtataaagggaatcaagagaggagagaagagggctaatgttgtttcttcacctctccccatgagaaaaatcatgtgaaattgttgcaagacccatgaaaggaattcatatataatatttctgtaccataaaataatatgattctatttgagaaaaaatcatagtacctgagtgcaaacagtattcactggcttattataatcaatttgcatgactaatatttctgtttgttttctactcaggtgacatatttgttcgataatggagggacagtcttctttgctatttttatggcaatatggggtaagtactttcttcattactttctatcccttattttctgaagctgtttctgtgttacacacacacacacac

SEQ ID NO: 1996 - DNA, 795 bp, Homo sapiens
caggattcttttgttttattgataacagaaactgtgcataattacagatttgatgaggaatctgcaaataataaagaatgtgtctattgccagcaaaatacaattattccatgccctctcaacatacaaatatagagttcttcacaccagatggctctggtgtaacaaagccattttagatgtttaattgtgcttctacaaaaccttcagagcatgaggtagtttcctttacctacgatattttccacatttccattattacacttttagtgagctaaaatccttttaacatagcctgcggatgatctttcacaaaagccaagcctcatttacaaagggtttatttctttctactcaatttttcttaaaaagaatttcaagaatcactacacagctaagatatctgagacttgcaatggctggagtctatcagtacaatagtaattgcaatcagattcagatacaagagaacaggttctaacaatttcataattaagttgatattctgtttctatctataagctcacatttaaaaactacttcctcgaactacttatttttcctcagccacaagtaagcgcaaatccttaaaaacagtgggttgagccccagctccatgtattaggtagctaggtatattgtgggattattccttgttaagtcaccccaggaaacatttgcagaatttagaaatgcatccagatttgtgagtttatttttaagacctgactaaaaatctgcactcttcaaaaacttattgatgaagtacaaattgaggcagaaatttacattcct

SEQ ID NO: 1997 - DNA, 1005 bp, Homo sapiens
aaacactttatttataaaaaagtacatttttaatcctcagtacattttcaacccatcatttttttttaatacaagtaaaagggggtgatgcaaacaccccccaggtcagaaccaggaggatctgctgggctgtccctggaccaaaggcggaaagggcgacaagacgccgaagcaaggtagcgcatcacgctgggaggggagggtggcagcttctcctggattcttttcatttatacaaaaaaggaaaaccaattttttcgaccaagaatcccattcctcacagcaggggtcagaagagcagcagcaccgagtgggacaggggctcctcctggcctcacaagctgggcagtgttggcagcagtggcagcagcagaggggcctgcctcctggcatccccggtactgggcagtgtgtgaagcctccctgtgggtgtggggacctggggcacacccacctgcccctcactaggagagggtttctgttggcagtcaggctttgggggtctctgtctggactcctgaggcctgggagcactaccctcctcccagaagaggggacatccgtgtctgcttggctcagcagagctgcccacacccacctaacacaattcccaatttctctgctctgaggaaggcagaaaagttattgcaccagtgacttgggcaagtgggggttggctggcagaggaagcgcatgcccaggaaacagggcccctataaggctctcttgcagcccgggcactgggaaattcgtttctccttaatggctttcagcaggatcagaccattccctctgccacatctgtgctgagtggccatctggctgtgcatgcatgcgtgtgtacatgcgtgtacacatgcctgcgcgtgggtgtgttggaggtgtgagtgtgtccactgtgggcacacgtactgggtctgaggtggtcgcacttgcaggcctgtgttcacctactctgtgctgctgcttttcagacccttctgataaaaggggactcggctggtt

SEQ ID NO: 1998 - DNA, 916 bp, Homo sapiens
tttttttcaagtattactatctttattatggtatacagcagtattttatacattagctcattttatagtaaaaacatttatgcacaactgtagagaaactgctgcacagatagctccaacttaaattagaaaatattttctttgtagaaaatagtaaaaattataacatttaccaagctaacccaacaagttcatttaaaccaaaaagtagctaaatacattatacatttataaatacaggttgaattctgggatccaggagaaactttagtcctttattgaaatagccatgttttaagttatgtgaagtgaaatttctattaatcttctctcttactcttaatttatgccagattatttttctttaggctaaatccataatccacaacaaggttttagctgttcttttctaaaggacgggtaccatatccttttaatctgcttgataaggtacccatgcctatccaaataatgaaatggttcagttattattaaagcatgcccagtatttgggcaaaaccagaatctaataaattacactgtcacctaatacccatggcttgatgggaagccatcgaggaacaatgggtaaagtgataaaactggcaagtggatcaagggaataaaagcccaagagaattctgagaccagagggcaagaaatatctagtcgggattcaaggacagaactgaagttcaaatagaaaaagaatgttgcctcaaggattaggagctgagctggctatcagagctcctagtacatggtgatcaaataaggggcagttagagataaagactggattaagcaagagaaatcaggaccaagaaagattctaggtattcacaataattaaatgaaaacaagacagaccatgcagctttaaatttcctagcatagtagttccaggattctcagt

SEQ ID NO: 1999 - DNA, 1010 bp, Homo sapiens
cctttcaaatcagcttaatcaaagtttattttcacaatgctacagaggtaagtccccaaactttacaatcctcatttgtttctctcaaaaagatctctttttttaaaaaaaaggctttagaataccacaccatgtttaaaatcctgtaagctatttttgaaatctaaattaaattctgacaatgataaaatgtttgccagccaatcaaagtcccaaactaattaacattcaaagtaaaaaagaatcatcattgggatctcattatattttgatagctgtaaaggctgattgactcctgtcattaatagtgttagtgtcataagcaaataatatcacttatattctagaaaaggaaataagcatatttgtcttgcacatcttatacactgaggtataaaaccatgttttaccaactttttttattaatgtaccaaataatttcttccacaatggcaactgtggtaaaaacccccatagcattagccaacctgctggcatgttctatggtcttctaattaatatagtgcacagacatttataaactacacagccacagtaatttacaagtaactaataaatattgaaatgctgggaatataacaaaactacattctaaatagtttactttccctttttccttatattattacttttatattcattcttcccactcatttttttcactagactctattaaattcaagatttaaatatggctaagcgtaagacaaaagagatgagcgtcaacaacacagctgaattttatcagtgtctaagccacttaaagctattctccacaagataagttattcaacccaaggcaaacagagaaagttggaattgaatcctaggttctttatatttttaactgtcaggtccacaggaacatccaaggctcaagttttgaatgtctacatgtcatgaagttaactatggcactagtggaatgtcgattactgaagatgaacccctagacacattcagcaagacattcaacttgcagaaggcag

SEQ ID NO: 2000 - DNA, 1771 bp, Homo sapiens
tagattttcatctgtttatttttagagagatcttgtacttaactcactagtctgggatgttttatttatgtcacctaatattaactattgctaaatttcactttaataaaaaagtagatacaaagactcattttacttagcaagactgcaaataaaactaagacataaattcacatgttagtattgtccaaaacaattcctccagctatcaacccacggcaatcaatccagcagtatcatttatagaatgattactaaaacaagaatcatttctcagttacaaatggggtcattaagcccttggggctctttgaaagtagaagtagtttgcctacttaatcatcagtctacacaaaggcagaaataaaaaggaatggaaatacaaacacaaaatgattggttattacctgttttataaggaaacaagaaaaaaaaaacagtggctagaaacaacaaaaaagcagtggctggaaccctactgaatagagcttaaagaagtactggttacattcacagacacagtagccactagccaagatatagtttatctccatcaaacttaaatagataaagtcagtaagtatgaccatcttactttcactatttacgctctttaaatagtaaaggtatcggtttgaaagatacatagaaccataggaacagtgaatgatcatttataaaacagctccttttcctgaatcaatatattgctaaaattctttcagtaaccctccctttttatatgatcacagatccctccacatctattttattttagttatataaaaattattaataaactttggtttccttgcattcggtccttatattttaaaaagtgattaaaaacagtactgaatatgaatcacttctgcaaagtttaatgagtgagaaacattcaaccaaggtgatttttccttggaaaaccctacaaaaactgaattttataaacagttacttattttgatagatgttccatttataaatagcagccattacttcactgtctacaaaattgcaggctgtcacattttacatgtttagaattcaaatgttttaagattagattttctagtaagagttaaaataaaaacaaagttacacagacaggttagttgtcctatgcaaataaaacagctgattttcatgattttgctatttagacagataagagacaaccattggattgacactaatgtgtaggataacatattttttgtttaaagaggaaatgatagaaacttggggtggggcagctgcagcaggacttgactctactgaggctcttctgtgctcatgggacaagctatcgcaggatgttagtaccggagaggccctcaagttaagacctgagcaaagtgtgctattcagagaagctgagctatccctgctcccggttctactgtggtgaattggtgttttctgaggtctaggcaacaagagctcagagtagaaggagtagacattttcgggaagtgggatgctgggcatgtcatgttgctctaacaagtgattaatagcacggaaatgggaggaagatgaatgtattttaaatggatactccctatgctagtcttgggaaatgaccttcttttcttgagacggagccttgctctattgcccaagctagagtgggatggcatgatcttggctcactgcaacctctgcctcccgagttcaagcaattctcctgcctcagcctcccaagtagctgggattacaggtgcctgacaccatgcccggctaatatttctatttttcgtagagatgg

SEQ ID NO: 2001 - DNA, 875 bp, Homo sapiens
tgctatctgaaaaccatttattgcaacgacaaaactagaggttaattactttttattattgaattatattgtaaagtctacatctacaatttaatcaggaagaaatgctttgcatttacatcaaggacacatttattctaatggaataaaacagacacacacaaaagaccaagtacatgtttttaaaaaatgactacatgtttcacctggtcctatttttgctatttggaccatacttttaagtgaattgatcttacatacatgttaagtctgatttatctccccacatttttaaacactaaatgaagcttctcacaatttctaattataaacaaaaggctgaaaacagtatgggaaacaaagtttcaaaacaaagaaaagttgagtaaaaggtgccccctctatggctcatctgaaagaaacattttactcagagaggcaaacatttctgatctaggagtaagtttcccactcactttgcaaggacccactcattctgcagaaagacctacaagtctttctggtctcaattgcaaagtacgtgaaaatgtgtatgaaagatctaaaagctaaatattagaataaggctaattgaaatcaaaattgtgtgctggtctaaatatacatcttcggcttcttcctttttagtaagtatttttatttcagatgtatttaaaaataacttacatttttagtgtgctttatggtcaatgactgtaaagttgaaactcaaatgagtcagtttaaaatttttgtctcatttgattctattgaaattttaatcacctactactttaatcaagttattcatgaggtaagtttcagcttaaaaaaaaaaatcatccacaaagataaccatttcaagagtacacaaa

SEQ ID NO: 2002 - DNA, 810 bp, Homo sapiens
atatttcaacactaattttagtaatgctttacataggagttcttataaaatatttacttaaaattcacaatttactagatgtagtcatatagatctaacacagcgcttagagacaaactttattggggccttaatggatttataggaatataaagttatacaacaagaacaggatgtcaccaaaagagttcactggttggctgctgcaggaccatctcacaggcattgtttgctttggtaagttcaccatgatccagggcatggccttaaatctcagaggtcttacaacccgatcttgcccatgtcttagaattcatcgaaattcaggaagtgaaatcgtgctgattacatcataagacttaaaaagcacaacttccaggttcaggacaccagaaaaagcagggtagcattgtaaataatcttcattgttttcaccaggtgaactattatatgaatgcaccagggaaatggagtcatactgcaatcactcaaagactggtttagggtgggagaaatttatttctctacttctccggaggaggagggtgcgacttcaggccggctgatgcaggaggaggtgcggagggtagagtggtactacctccgttgggagttccttccggataatcccaacgcggagcgaggaggcagcgcttttttggaggcttggcttcccgtgcgtttccaggtgggagagtggatctcccggaggcacaaggttggtctcccataaggattacagaaacgggtcgtcagttttctccggtgggcccctgcaaagccaagagacctgagatggcggcgagtccc

SEQ ID NO: 2003 - DNA, 828 bp, Homo sapiens
ttaaaggtaaactcgtttactggttcagcacacaattctcatgatcattaatactctgacttgggcctagacttcgtcctaggctgaaaggttgattcaggtacaattaaattttctggttaaaaattgtcattgggttcaaatgatctatcatccctctagaaggcagcaccagcagagaagctataaatacactcacttcaaaactgagctttaggggtggttgtaccttaaccacacaccctacagccaagagaaattagcagttgagcaaagatacagaccaaatgcctctgggagatggactgaagcagctccaaagaaagctgtaaaaaagtgacaagaatttgttcttccactttgagactgttcgattcaaacatgagtccaaggcacgtatccttaagaggagatgctctgctgctgtctcatttgccagattatccttcagttccaggctttcaacaggatatgactggttcatgctccatgataggaaaggaattaaagtttgaagccagaatgaatggccacaatgcctgatgttagactttcgtaagtcaccttgtgaaagcctgcatcttctatcatgtccttgaactcttcctgagacggaaaccttcggatactctctacaaggtactgataggacttccagtctccagcgatgacctctcccaggacagggatgacctggaagctatatagatcataaagcctggatatgaggggattgttcacttggctaaattccagacagagaaaccgtcctcatggtttcagcacccgatgagcttcctggagtgcctgatcaatgtgtgtgacatt

SEQ ID NO: 2004 - DNA, 989 bp, Homo sapiens
aaaagtatcaaataattttattatgaaagataagccatttattgaccattcacttttctaaaaaaacacaaatgtgagaataaaataaacatacctaagactcactggcccctccaggacaggaagcagccctggacagagagcctgcaaacgagtttccttatgcctaatgtctgaacttctcatacattctaggatttcatgtttcgttacaaaggaaaggaaactggctagaagattcatgtacaagaaggtcacaactttaaagctatctgacgctaatgacttgtacaatctggtttgcaaactctgagagacagtatcaaataagcactgtcaaagactactcccagctaatctttactgtcatttttctttgaaattgtctttgggactggctatgttctcactgtagcttccgtttatcccacagcacaaaccctaaagtccatgtgcagtctccatgttcaagtataaaagtctgtttcaggacaaccctgggttgctgtagtgtttctctctctgtagtgtctacttggtgtcatgcccttggacaggctggccaaatggcagcacaatgcagggggtgacacggtcaactctcccactgccgaacttgctcccctttcaatctggtcactgcccatggtcaaggttgaaatcttgagatcagtgacgaccttggcctatcttcagtctgaagttgcactcttatgtaaccgaatccatttcttcaccaaaaattagctttcaaaaggtgtctggcgtattcttaggaagtgtcctgagatggagctggagggtcctggacttcgggctctggagggggtgctggcacagctgcttttttctgggccgccaggaactcatgaattgctcgttctatttgtggcctgaagatgtggttaagttttggatccaccacctgagaaataatcctgtctactccagcttccaacatccctgactgaaccacactctgcctcaga

SEQ ID NO: 2005 - DNA, 1104 bp, Homo sapiens
gcgtgtcgatctgggggacagtttaataaactgccacacaacacagctgagctccacacagccacatgaggatggggacagccattccttgggtttctgaataacgtatcaagtgagcagtgaatttcaatcaagcttgtacatcaggaccgtcttgccaaaacaacagttgcttttggctgctggaagctgtagcttttcaaaacgttcacacatttcaatgtatcgtcgatgtttttaaatagacttacagggagggtggcacacagcaaaggcccgcaggccctcgtagcaccgcagtccaggtaggatgctgggcggcggggggtggtggagggggttctatttacagtgtctgggctttgactccactaactgttggttttgttttctttcttaaaccttttccttcaagtctggaagcctgtggagggcctgtcaccttaaaggcaaggattccttgtttgcaccaggcagacaaatgtcaaaccacgaccccaggggctgcactaggcgtcgggcccagaagcccctggccatccagccccgactctttcatgcctctgcccctgatgaggggacccagggtaccctcaaggggacacagaagggaggctgcatcctagtccagtgtcaaagtgaggggggcgctgcaggagcctggacaggaccacctagcccagccagggacaggagggtgagaccacctggaacaaaggcacagaggctggagagaaggcggcatgttcccagactgcatgggctcggggtagggggatgcgaggtcagaactggcatagtggccaggatctcgggctctactccatgggcaggggggaacccctggggctgcatggggccatggggaaggcgggcgcaggagacaccggctgctgtccaaaggccccagtccagctgctcctctgccagcagaaggcagaggacaaggggctggcccaggtggcctcgtgggacggggggaaaggagggaccagcaaacccttcttgggatggctgaggacacaggggactccagcagaaagggaggcccctgggtgtgcaagacgggacgctgaccagcctgggcctcaccggccactaccc

SEQ ID NO: 2006 - DNA, 1247 bp, Homo sapiens
gaagacaacctttactgcatgttgacgctgatttaggcaatagcttcctaaaaatcatgtataaagttagttagttagacatgaaatctcttccccaatgttgatacctgcccacaaaatattctcaccttcagagtataagaatcattcttaaagccaaatattcagttcaaggcacatacgtcatctgcagttgtaaatttgcatttaatatttcacaattcctgtaagagaggctagtcaggagggaaaccctcaagtttaaatccccacacttacttacttactgctcatccgtcactttcgctaagtgagattaataattcagtagctggtccagaacgcacagcttgggaacgcagaggcccaggcctcatgtaatttcccactcccgtaactgaacgtgctgacccatgttgatgtctgccttcatccaggtggcaaatcagacatgctacgctgcccccttcaaacgagttcctcgtgttaggggcaaaggtcacagccaaactctgccactgacagccagtgccttggcctggatcctctctgtggatgcaggcctacccctcctcagtccagcctcatctactagaccagcttggccattcacttttcggatgtctgtgagcacaggactgcagactgaactctcactcaagttcttccatttgccaagcccgaggccttttccggctaaccagccctctctgcgctgtcttgtctcctgactcccaccctcaccattcacagaccatcacgacacagaggatgccaagttcttttagtaattcaccagctccatgcagggacatcacagggctgccctccatgagcagaggaggagggctgcctggcagagcgtttcacactccaggttagccagaaagagcatcttcatttttgtttccacacaacacttctctgtgagcctgttggccaacaaagtggcggccgattgttggaggagccagccaaccatcttgtctaacttcagattcttcagggctagaatatgttcaccccagaggcttagatgaagcacatttgcggctactcgggcagatggtctcttgctggcctctcgctggagcagtgccctcaccaactgtctcacgtctggaggcactgactcgggcagtgcaggtagctgagcctcttggtagctgcggctttcaaggtgggccttgccctggccgtagaagggattgacaagcccgaagatttcataggcgatggctcccact

SEQ ID NO: 2007 - DNA, 700 bp, Homo sapiens
taatttactaaagcagaacattttactccttgatgaatccataaaaatacagcacaactgtattcttacagtatgtacaaaatcttattttatccttttattttcacaggcaatgcataattaggttgtttttaaatgagatattatgtaaaattgatagcaataactgtcacacacctctattgccattgtagggtttttctctttctctgatacttttttgtgtgtgtttattcaacatttatcaataagaattttagtgcattcactaagagccaagcaccgacacatcctgatatgcttccatctaggacttttagctgcttaaaaacatttaacatgcttcttttcctccagcaaactcttttaaaaaaaaaatgaaactctttccttcaatgagattatttcagaagttgccagtcatcttggaacccaaactcagtaataagcaactgtggcaccacaagtggaaaccttttgatgatgggcccagtggtttcatggaatacacgggtttactgctataacccaagagactccagttgagacagtctggctcagaccacatgcatccacaactatgaacaggagtaatgcctggactcatacccagttctcttgttgactatatctttgccaaaggactactgactagttttaatggggccaagaacacaaatatgtatatttttcttataaa

SEQ ID NO: 2008 - DNA, 1519 bp, Homo sapiens
caattccacttttatttcttcaaggattagctaaagacactgtcaggaccgagtatttaaaatgtgtttggaacagagacacacaattgggacagaggaaaaaaggattcatcttgtgagtcatcaaaagtgctttatttgtaaagcccggctcatgactggagtgtattgttagcactaggagataacagggcaaacgtcctcactctgtccaaatggtttatcaacagaaataaatgacagactgtttgttatagacaaaaataaaagcattctgtaaacttctaaaagcatacacagattggcccccaaggaaacagttactcaaataatgtatgtgtaccttatctttacttcagggtctcatggttgtggtcttgggtcaaaccacagtagaacttcacaacacaaaaactgatctgatgccagaattaatggtgcagggaaaaaccaaatcatagtatggattactttaaatacataaaagatgaatctgtacactacgtgacagtggtgttaacactggctgctgaggataccaaatctacataaaatgagtggacagtatacggagggcacgactgctggcttccaaagactctgtgaactagatccacatacacggggcacaactgcaatctggacagccctgaagtaaagttcctggaaaaggcagtacggcagggagatctgttgagttgcaagtaataattaaagggtcgatttttgtttgtttgttttcttttctgaaactgcccacaaaaatcatatcatgttttaaacaaggagtttcaaaggcatggctttagcgcagcatgtaagtggataacctactctaagcaagactaatatttaagctcaatgccttttggaaaatgcaggagagttggtagatacatgatctaggttggaaatttataacttgattaaaaacaatcagcacagtttagggcaatgaactttcataaaccagactggggcgaaatctctttttaaaaaaatcaatcattaggttgataaatgtacatttggaggaaaaaaaatccttttccttttattgtgaaagactgtctaccatgtactttgactaaaacactcacgtaaaaacatggctgcaggatacgtctcaaaatatgacaaacgttatttcacctatactgtgactttacatgtaaacttcaaaaatcacatgctgtacatcaaatttttagattcaaaagatatccctgttttcctaataatgtaaacagtaaaactgagggtttcagttaaagggataattcgtaacaaaatcccattgttgaaacaatggtcaaacataaacatcttataattcagatctgcattcggtaacaggagaattgagagttttgatgctttgctggttttcccacagtgggagatgtagataccattgccccaaactatgcacttttcaggtaagctttacttttattttgtagcattaattcctatattgcaacgtaagggtgaacaatgaagctccaggcaagaaaag

SEQ ID NO: 2009 - DNA, 722 bp, Homo sapiens
ttgttccattagaagtattttattttaaagtacacttgaaattttaaatgtgtacaaattcagaggtttaaaaaacttcgaaagtcacagacacagaatttaggaagctgaaggctgagagtctcccttctcacttaatccatgctttattttgcattcctcacaggtaaggaggcagtgcctgttatgctgtggaccaaaaccagccccacggagctgatcttcaaaaaaatggaatttactctggcatactcctatgtatgatacctttccaaggccaaatcccaagagaccagcaagtgcaactttgggcaatgatccaaatctagaattagctgccaaataaccttggtagactagtccctgggtgacaagcatgcttacaagagaaaaaggcagagctctcttccagaaactttcttcctgacattctcgcataatctttgagatctctgctctgtggatgtgcagttttgattttggacaaaacaacaggctctgcttgcttggtggtggaaaatgggcatctttatcttggtttccacgagcagacgctgaagccatgatgactttgtgcttgctctccttccagttgtttatcctctgcttactccttgacccagtgtctgtgtggtctgggtcgcctccgaggccgagtccctcgttgccaagcccagcaggcctcgctcccccgtgactgcaccgccggcgcgctccagctt

SEQ ID NO: 2010 - DNA, 1690 bp, Homo sapiens
gagcttccaaaataacttttattactatataaaagaagtcaagaaaaaatagatgcatatttttcctacaaaattataaaatattcaggatagttaatattttttccataaatgcgctaagataaaaagatagaaatctttttcacttaaggttttcgagtaccttgtaggaattaaagaataataatgttctttcttctacattttcctaaagacatagcagttacagtttcctgctggagttatctaaaaaaggacataccaagataaattttctatcatattgaaataaaattagcataaagctttacttctgtctttgtgcttttagattggcaactgtggtcaatcagtgctgcactggaatttccaactcagcaggggaaagaatctaattaaaaatgacacacactctgtattttgtcctttagaaaacagaaactgcttgtcgatatcccttaaaaagtgcaattgccttctttgtcatttctttgtaaagtctgagatgttgtttctaaacagcacagcttacatgaaaccacgcaagtaaaggaaagaaagtgctttagagggcaggttccatttgacacaagcagcacaggaagccgtacacttttgatgacagtaattcaaaaagtatattcatttgagtttctcaataaacgctttgagagaaaaggctttaatgttgattcagatgagtgttaaaataaagctttcttttctgaaattagattatggggtaaaccaagccagattatctctggagatgacagaagccataattattttgggaaatttcaatcactgttttggaattgatacctaaggctttcttctcccctattatttatgggctttttaatgagatatttttctcgggagatgcttaggtaggaaatatcagcttttgaaagataaaggtacaattatcattagaatcaaaagcccattaaataagagtctcaaacaaaggttttctagatatattttatatacgttgttttcataaagatagaaaagaaattcctataatatctgtaagattatcctcacattagcccacatgaaagataaaataaagggctgagatggggggtgcttaaatactttgcaacagtgctattctagtgccaaagccataattaacttttcactgataacctgtttcttagcctatacaaaaaggaatggccacctcaattctggcggcttagtcactatctaatcccttcctccaaaaaccctggaattttgtgttcctctatgtaatggaacatccaacttatcaaatgatgtgtgactatgcaactactccttctatggcaccaagactgtaccatgctccacccatactgaatttaattgtgctaccactttgtgccaggcagagggctgggtactggggatccttctggctctattaccaattttggaaatagaatttagtagagaagaagagaacagtgttgcagcaaggggatcttgaatggtttttcatgaagtttaagggatatgatggagtgtggcttgtattcagtctttggaagtaagtaccagttacctaaaaagaaatccactaagcaccaaaatgtttagtgtatttggtgtagagtttctacccacattaaaatgcttcagtttaaaattgaagggaaggcaaaaaaatcaaccaaaaaatgaaaagtat

SEQ ID NO: 2011 - DNA, 747 bp, Homo sapiens
tgttttccaatactttatattttattatttttatgactaaagaaatctgtttttaggagaaaaatggacagatgaacaaaaaagaacagaaaaaatcacccagagataaccactgttaatcttttagtggacacagctttcagaattgttttctatactatattactaggtaagtatctttgtagttttacaaaaatgtactgatgccatatatttggttctgcaagttgtgttttttaattttacaatgcaccatcaacattttttccatgtaacagatgaacatttcctactgagaacactgcattgcagataggtcaaaaggctgctagcaacaggagggatgcctaaagtaaagtattaccgtaacgttaaagcacatggcctggtaaatgcctgccagggacactacacataaggaatgtcttcaatgtcccttcgtggggccctgcagccacccctgaattcccttggacctctagggtagaaggggtcctgtaaatttctttgcatccacaaaaacgcccccaatttctgtttgctttttctcttctcatcctgcaccttagccatattgtcaaattctcttatcatgtcctcattgctgaaattcatatcatgtatggcctctttatactccttgaggtaatgagccagccccttattagtttttcttttggatttcctgggtacatcatcctcagctggggcgctttcctgcagcccttgtttcactccctggctctc

SEQ ID NO: 2012 - DNA, 1514 bp, Homo sapiens
tactacacagaagtttattgtgaaagtaaattaaacaaacaaacacacagtatggccaatggtggcaaaagcaatctggtagcttaaggcaagttttaatggagatgaatttagaaaagatgatgcaatgatgtaattttgtttaaatatagattatgaaaaaatatcaaattgcatcaataacttaatagaagtagttttcaaagcctgtactactggagaaaaagggctcatgatcttaatgccagcattaagacagacagaagcagcatggtgctaaatgacagaaaaatccagtatttacattaggatggtaacaggaacatttaagagcatttgatcttatttactggtggaccgaaagcccttagctagacaatagaggaaaatgtaccatcatcatgttatttaaaaaaatttaagtgcagaagtaaaaaaccaaggagctctgtaataaagtaacataaaacaccactgtaaggatcacttaaaaagcgattccctcaggggaaattagggcactgagtgtgtaaacatgtgagctgtacaacaccaaaaccaaccaaattcattcatagtacttatagttatgcaagatcagcatggcctttaatgacgcattattgtttgtaacaatttaaacacactcctttccatgcataacttcaaatatataacaaatacttttatttgatacaggatatctgtttatgaaataagacctatatacaatgaaagtaacacctccctcatcagtcaagtacagttatatgctttttaaatgcaatgaccttattcagacttcagtccattttctgaattgactgtgtcagtttttcaccctttaaaataatgccatttaatgataaaatacatttttcaaaaattcagaaatgtagtaacatttaataaatgtgaccatgaaaaatatttgtaaggaggtgccaaatgacttagcactgttttccacatctgtatctaaaaaaaaagttgcaatttgacagtaagcctatttaaaaaatattcttacattaattcatctcaaaaggttctattaatagtccttttgcaaaataccatatatataactgtgaacgttttttccagaattaatggaagaaaatgcatcctctgcacagatgaacattttctctctaaaactaatctttcatcacccagcatgtttttacaaaagcatgcaatataaaatacacataaaagcagctatcttaaacatgattttaatacaatattacctttgtagctgattcatcactgtctccagtttaatatgctgttacatacatgaagaagctccagtatcccttttctgattgactttttaaaaaaatccctgaataaaacagaagccagcctgtgacttctttaggcatttcagtagaagatcatctatggagaatatctccaaccaaactcatgattacagaacagaagctaaaacaatctagggcagagtacagagttaataccaatttaaaacttttatgtttaaa

SEQ ID NO: 2013 - DNA, 1344 bp, Homo sapiens
agacaaagacatggttacttttttatttgaagaaaaaaaaaagtatgttttaataaatactgcggaaacattgaccaaacaaacatacacagtgacttcaacagtttaaaaaatgcaacaaaagttctgctttataacagttataacttattttctttttacaatatttaaatacagaaagcactcgccagctattttgtaatactgcccaaagcataatgctgcatcaatcaaagcatattatgttggtaaaatgtctgtattttatgggaaatgactggaatcgaattttcttgcagagacaagacaaagtgcttgtaagacatagaactgagtgttgtaattaccttaatctctcctgccacgatttaaggggagcacagcttcaacacttcaaaaacgaagcactatcatgggaaagaaagctcgttttcaacaagcgccaacaataaacaggtcagatctggtttcttctctgaaagaatctctaaaaggaactggtcaaaaatatctgtaaactattttaaatgcttattattttacgtaacaacagagaccaagtgctgaacacagaccttggctgcgtctgttccgtgaggttttagcaatgacactctagaaatgccctagtgttatgtcaggactgaaagtttatcatataatcttccactagggattctctaaagcttgggtaagtggcatcttctctcatcaatgttcatttaatgaaaagtgaaataaaccaacagattatcagatgctgtcagttttggagcttcaacccaaaataatagtccttttgctttgtatttttggtaacttaattccagacagctttactcacaaactgtgctttctgctactattctttccttcactcattaccttttctggtgaaaacagtaactaccttttttctctccttggatcattctatgacatcaaaccaagacaccttttatttgactttgcatttttatcaacgatggcaaaaaatcacacaacttctaaacagcgcacaaaaatattacattgagcaatttaccactttttaatgacaatcacaatgaagaacagaaccatcagactgaataaaaatcgacattttttttcctatttgatctatgcgatctttgtagtgctggtctacaaatcttgcaagattgcaaaggctttccttagaaccatcctactcagctatcttcaggaaggcaagatttcaaagcctcataaagtttgcctctggatatatcccatgggtcctgatacaatttcctttttaatgatgagctagaaagaaattagatcacatcctctagaaaactaaatgctaaggtcacagtg

SEQ ID NO: 2014 - DNA, 615 bp, Homo sapiens
ttagccacatgaattaagcattttatttaattatcacggaccaccttaaatattactttacaaaattcaggcctatatttaaaataggtgtcctgataacttccaggatattattcggaacacccgtttccccaactacgataagtccattgccggatgctgaataaacttcgcccattaccacttggatttcttgatagtcttatgtttccatcatccatcgtaatgtgttcagctcagcttccatctggctcaaactgacggttctcggggtgctagggcacaagagcgacagagtagactcaagatggccacatgacacagacggctgaacaggcttcaccggagtccccgagtgcacggaacctttccccgagggcccacggcccacgcacgccggggttcagggtccagggctgcacgtggacgcccggcgacctaatgagcactcaagtccgcgcatgcttgtaaacttaagggtttccaaagccgcccccgacctaccaatatcctgactgcgctgccttttaggtaaggcagtaagtttcggcccaattatcattttaacttacgaaagacaactacgtactttcacctaatcccgacgcttcccga

SEQ ID NO: 2015 - DNA, 986 bp, Homo sapiens
ttataacataatgggtttatatttaatatagtacttctcatcaggaggatgttactcagttaatataaagttttttttcaaaacattaaatctcttttccatgtcaatgtctatagtttttttttaacattaaatttttttccgcatttcagtattagatacactgaatacatttttctaaatgttttttccctagagataaaagttttcctttttgcctgactctctgatatctaaatataatattaacttgggagacaacaaaacaaaaatctaatttaaaagactcctcaacgattcaggaggcagtgattataaccgaacagtggtgatttcctaagattctgggcaagaacttccttcttcctatttcacatgctttgagagaattctaagattatgaaatattacttatgtaaatttcagccatcttacttctttgactacctaactagcaaattataggctgcatttttctgtgcattatttgttgtaaagaaaacatttttttttcaatttataaatgtatgtttgttgccatttcatggaaacaatgaaaaatgtgaaactcccttatttactgattcttggaacctttcacacaccaaagctcaggtttagcctctaaagcgcaaaggttttcagggtgaggtttgactcagtaggcctttcaaagtcacatctgtccatttctttttcgtgcatatacccccaagcaggcacaaatgcctgtaatgctgagaaccacacctaacaaaagggcgattgcatcaccggcttctactgcttccacaacaggcagcaccaaaagcagtgacatgaggactaaggacaactgtgttgaaactgaggtcatgatgttggaatcttgagggctgaaggttccaaagaaatggtatatatagaattctatctgacttgaaattttcccttcctggagctccggatgctgagattaagaggttccacgtgacacgaccttctag

SEQ ID NO: 2016 - DNA, 1234 bp, Homo sapiens
tttacactccctcagacgctttattgtttacaaaacagatggatcccatagggaaggaacacaatcattatgctgacagcagcgaacagagaggggaagaaaaaaggtgagctttaaagtaatcgcaaatcactgcctatgcgaagaggctgcttccgggcacctgggctgtgactcaggtgctgacatgaatacatcagcaaggtctcaattcagccacagtcccaagtcccccaaccttcctgattgcatctctattttaaatgacccagcctggacatcaaggacaatgatctaggaggcgggtcaaggagacagccaggcaaagtcagaacagacttggggcttccaggctatgcccggtgacagctgagctcttcagaaatgcgtcacattcagcgttcacttccttcgcttcctccactacctatgacatagcgggggaaagagacaaccatgagagaggggtccctcctcgctgccctcctcgcagctgtgcttgagtttcaaagggggagaggtttgtgagggaccggcacagggacagccagagccggcaccctccggcccaccgtggcacccctgacgatcgcggggtggggtaggagtgagggtgggggtcggggtgaggtagtgctgtggggagggcactgtgaatgatggaaacgtcccttctcagcctgggtcgtgcctaacctgggtctcaaatcccactctgccttcaccctggagtacactccagcgaagccgaggcccagccaacgctcgtgaagtttccacagagaagagcctgcaaaactcccactggaagaggagaaataaaggccatggaaagaaaccccagggaagagacaggcctcgttcacagaccctaggcagggaataaaaaattcaagtcattcacagaagtcttgaaaggcatgaggatttctgacagttcctagaaaaaggcaacattttctttatctttgtatccattggccaagaacaccgacatgtgagacttgcttcaccagccgccaccgcttccttacaatctccgcactgctggagcgggctgggtaactacaggactgtgctctgtgtgataagatttggtgattccactttataagaaaggaaactgctttaattaaagcaggttaataattaaaacttcaaagtactcacagccacagaattttcttgaagggagaaagcggtcactggccatatgatgcggagatggttttat

SEQ ID NO: 2017 - DNA, 873 bp, Homo sapiens
agcattttttaaatggctttattaaaggctacaagtataaaatatgactaagttacaagtcgtcagtaagaatttattacttttgaaaatgttaattaaagaaagggagacgcaaagaaagggaggctcttcctgaaatccacacaggggggtgcggctcagacgggtgacagacccccgctgttcccagtagggcagcacccccaaacccagggggccaagggaggggctcccagatgaaacagaggctggttgctgatttcttgggggaacttttgtaaaaatgaagacactgaatccttgagctgaatcccaggtgcagagactggggggaggtggagaatccaaaatcatgctcaggtttctcctgaaaagtgtgtattttctaaaaaataaatataaactcctggtttgagaaactccctcatgatgaatgggaggaaaatcatggcaaatggagagctaagaaaccatcttcgcatagactttgcccaaggtgtagaggaagatctgccggtcaggcaggatgaagacccacacatgagcctgtgtcctccaggtcgtcccttcttccaaaagcacagcaaagcaatacaacttgaggactccctccaagatttcctaatttttgattttacatttaatctcaggaggctataccattaagaaacattattagagttattgctgggtgctgggccccagacgatactaagtgaggcagaagctttcaataattcctacagccctcagcaccaagaagaacttggagggaatattgggcttgttgagaaagtgggaaagaaattagaatttctcccaatagaagaggcagatcaccttggcctactctctaggacacaggtctttctt

SEQ ID NO: 2018 - DNA, 942 bp, Homo sapiens
gaggttattacacaaagaaaaagattttattgtcttcttagtcaatatccctggtgaaattagaggcatagcttgagactggtgacagtgcaacacagaccttcaggagctgctttgaggactggcctgcccagatgcctgctgttaagccagcagccccctcactccggcccctgccatcttgacagatggagctgccatggtttcagggacactcagcagggcatctgggttggtccctcccacatggaccttgtaaagttgctattcaggggaacctggtatcgtttcaggcaaaacacagaaccatattagcacttctaagccccctgccccggccgcctccctggaacatttgggcttgtcgcacattccaggagggagcaggagcacagctgcagccacagctgccaggaacaggcctgggctcccgccctgtgtggggggagggcagaggctgagggcttcctctgggggccctgagtaagctcaccctcaccccacctctctgacttcatccatccaaggccgcttggccaagagcccaggcagggtgaggggctgtctcccagaccaggcctgggctgcctagcagaggtgggggagggggagcttcaggcctagcccaactctccagaaaccaggggtagcctgctgagctctgaaatgccagaagtttaagaaaagagggaagggggcaagaggtggtggtggtagtggtactttgctatttaaaggtagaagaatgcaaggaagtaaaactttttttctccatttgttgtttggcgaccccattggagaattccaggaggcatgcaggatgacatcatgttttacaactgagaaatctcagtaattctgtaaaatggagtccctgcctgctccatgttcctgatggaagctgctttgtatttatgtgcttaaagctgtattttatgtcac

SEQ ID NO: 2019 - DNA, 401 bp, Homo sapiens
tttaaagtcaaaattgtttttattgtcagtcacatatttagtataaaaagaaatgcagcaaatggctcagtgttgtatttttaaaaaaatccaggttgtgcaggttgttctatttacatatgggagaagagctgttcccacatcaggcacagcagctgcacttctccgatgcccctttgcagacgcagccctgggcacacttggcacagcccacggggcagcaggaacagcagctcttcttgcaggaggtgcatttgcactctttgcacttgcaggagccggcgcacgtgcaggagccaccagtggcgcaagagcagttggggtccatttcgagcaaaggggatgctggagctcacaccagtgagacgaacaagcagtcaggcagttggaaagcagaatgg

SEQ ID NO: 2020 - DNA, 1417 bp, Homo sapiens
tttttttcagaagtaaaagatttttattgttctatagacacttctgaaaagagatctaattgagaaaatatacaaagcatttaagagtttcatccccagagactgactgaaggcgttacagccctcctctccaaggctcagggctgagaacggttagcatatcgaatgatcagtaaaaacatgcaaaagtgagaaggaaagggaaaaaggtgcattcccctaagctgagggggatggaatttcagaacagaggaggcagggtggacaagtaccaggtggctctccctttccctctgtgttatctttcaaaacagttccaagcttggagaaagcaatgagctccacctactcagcagaacccacggctcgtcccccgtggacgtgactgagcagtgaccttgcctgccccgttcctcagccgcccatcccactgccttgactgaggggaccctgcttgtgctcctggggggcaggactgggggtcctagctccttgcttctttggttccactcagagaacagttgtgcttgacggactcatccccactccccaaactccaagctcctgctggtgggctgaaggcactgacagagtccctgggacacccccaggtagccaccttctcttgtgctctggtgggtccctccctgggcacatcgtcccatcctcagctcaagccccaggtctaggaatagggacagtgaagaaagtgtaccctccaagaaaaagcttctgaggacttttctaattgtgcagatacttctgaagcccatgccgccccgaccccacagccccatccccttgccagggcctcacatgcccggctcccccaaccggtccttccccttggcgtgccggtgcagctgtgggcccaggctttggcaggcccagcttcaagacagtgggacacagaaaacactttgcagcatcgcctctccctccgccacacccaggtcagcagagatgggccccccaccgagagatcacagctctggtacagggaggtgggcagggttggagaggaatggagagacatgtcacctctatagaaacgcgtccaaagtacaagctaagcagggggaaggaggagggccagagagcagccggaaagaagaaaagaggaacacggcagggggttctgggggaggagggcctcacaccaccccgcagatgagcgtctccaccacgaaggtgttctcgaagtggcggatggcattgcagttcttggccccacgcttgttgatccgcctccgcgttgcccggcgccggagccggtaggtgtctttcccgttgcacaggtggtagatgaaggaccccagggcctccttgtcactgacatgctccgtgaccaccatctcctcctggatgatgtacgtctgcggcaggtagtccccctcttcacgttcatgaggagctc

SEQ ID NO: 2021 - DNA, 1301 bp, Homo sapiens
tagcaatacaaaagataaatatttattcagaacaaaacttttaacaatcaattttacattctaagccacaaggaaatagcaaaacatatagcaaaggaaaagcaaacactaaaagaaaagcagtgtactgtcttttctactggataacacttagttggcccatgacctctcgcttggcctatctcccaagtacattttagagttaacagctcactcataattttgggttaaaatccatctttctcctgagaatcaggagttgcacatgagctccagctagctgcttctctagggttcgtagctattgaggctaaggtgcaaatgtaaacctttggtaggtttctttacacaggggcacccccatttctcactggtggcaatgaatggggaaggggtagggcctccaaaggacctggcacactgtaatccagaagtggtgccccagggagcaacgaatgcaccctggagtgtggtccttggtccgttccgtatctcccaagtattcagaagcccctccttaaaaaccttctctttctgctccctcctccaggtgatttctcagcattcctctgggctgatcattctggagagatcagactttctgggccctcaagtgttgaggaaattgttgtgaagtgtgagaggtagtggaatgagcaccgggcttggggtcaggggactctactataggctggctctggcaccagacagctatgtgattttcacccagtcatttaacctctttgggcctgtttcatctgctggaaaaccagggaattggtccaaaccaactctcaggttctttccagcaggaatattctagattccatgattctataaaaaatggcttctgagccaccaaaagagctgtcatgaagtccatgcatctttgtgccataagagacgcccttggccaccattcagagcttattgattcagattatatacacttctaacaacactggtttcacaaattctcagaccacgtagattaaaagcagcaaattaaatgagggaggggaagagctgcaaaaggtagacactctgatagaagccacagtcaacaatgttttcaattcagcaaacactgatggagtgcctaccacgtgttgggccccgtacctagtgctggggcataaagatgagcaaggcagcccaaagggtgaaaatccaggggaagaaaaggtatggggcggggagggcgggaggggggcaaggagagagagaaaaagtacaagaaacaaaacaaatacccaatagaaaaacgaaaataaaattttaaaagggaggggcaacacatc

SEQ ID NO: 2022 - DNA, 816 bp, Homo sapiens
aagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaaggggcgccgcccgcgggggggacgcgcgcgtccgcggtccgcgcggggaccggcgtgtgaaccccgagagtgcccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgctactgcgtctggaggattgatatttatttttgcattgcgatggctgaaggcatttatttaacgatctttttacctggatatgtctgtgaggctcctgaaaggagacaaataaagtcaatatatttgcacaa

SEQ ID NO: 2023 - DNA, 675 bp, Homo sapiens
gactgaacgatttctaaactttatggaaaaagccaatgacaatcaattagccaaaaacgagacgccaaatcccatctcactccagcgccatgccctcttctcaaacgctcgccggctctaggacctctccaccagcacagttctcaggagtcctgctggtctcccagtgctgttctaagggtccacatgaaggcaggtcaggcgggactccccgggcaagcacttctgtacgcggaaagcacgaggcgcaggagccatggagagccggtcctttggagacaggaatacttaagaggattggcaaaccggagaaacgctgggagaggtgccccgcactgcggtggtaaggcagagtctcagttctcctcgggcttgtcggctggcggtccacaaggctgaagcatcttttccatcaagttgaagcggactcgcgctttgctctcattctccgcaatggcgaagtagttgagaaggtcgaagtggcccatgtaggagcagtacgagtcgcggtgttggttcaccagccactcccacttggtggtgtcggcgtggcccgtgccgatgtacttggactgcaggtgctccagctggctatggatggtgtagcggtcagtcatctcgccgctttccccttcgctctcaggtcagaggacgcaggtaacaactcgccgctct

SEQ ID NO: 2024 - DNA, 375 bp, Homo sapiens
aactaggcaaaggctttatctttgttttaaactattttctggctaattaattgccaataaataactgtatataatcaataattaaaaagcagtgtccaagggtcttggaatttatagacttacattttatcatatataaaacaaaaattttaaaagcagttaaaattcttgaaattgtattattttttagaagctgaatcaattcagtttgcctcactgttggaagcttcatcaaaattctgaacaagatcaccacttccccaatagtaagtggtacttttccatccagcttctgccagtttccttaagcttgttgacaccaagctggtttaagacactgggtggcatttctgttagctgctttgtctcagcatg

SEQ ID NO: 2025 - DNA, 352 bp, Homo sapiens
cacttaccacacagtctaatccaactgagcattcactagacctttttaaaaactgagaccaactaaaagacatggtacagacatcacctctcctactctcaattctcttaacccctggtgcaaggacaaaatcttttcctaatagggacatggttcctcttggaagaggagtgggaagtgaaagttagggtataaatggggcttcctggaacaaagctgatggcagagaggggtgggggagcctagagtccaggagtaatcagaaatcaattcagatcatctagagagtaggaaatcattacagaccagatgcaggagtcctggtctgcaaccaacgttcggaccctacaca

SEQ ID NO: 2026 - DNA, 340 bp, Homo sapiens
gttcaataatagttttatttacttatttcactgttaacttggggataatattcaccacaaagttgcaggcatcattttatagtacagactacagacgattgactttttcaagattaaaaatgaacatggtttgtgacacacctgaaatgcctactgaggaagtgctggccacgaggtaataaaaaaaggtaaaattcagtgcctttggcaaagatgtggacactgttttagatgcgagtatgatacatgccctttgcttacaaagcaaatatacacccatctgtttttggactgcggtttctctatccaccagagagcatctttaaatgattcacagaca

SEQ ID NO: 2027 - DNA, 393 bp, Homo sapiens
aattaaggctttcagacctaatctagccatgaccaaaggccaaactccacagctttgtacaactgaagctcagcagacctttctggactttctcccactgctcctgttctatagccagttgctgtgttcaccaaacttgcctgacccttcctcctcctgtgctttcactcactctcctcctattttaatactcatctccagcctgcagcaccccaggcagtacaccttcacatgaggaaaatttacccatctttctacgctgagttaaaattcttccttttatgaaacttccctgaagtctaccagcatgacattccttctctttcctaagtccctattgctcttctgcccatcccacacatttggcacctagtcacaagttgctttgtgata

SEQ ID NO: 2028 - DNA, 408 bp, Homo sapiens
ggctcatttggtaagctaacaaactggaagaaaagaaccagttttaactaaacaactctaaaagatctcagaatttgaaaacttagagttatgaatagatttgattcacttagccccaaaactatcaaaagaagtatataaaatattaatagtcaccaaaaccattgagctatagaattccagatattgaaattctaaggaaatgttgttttagaatcaaatcatgtactaggctgaaattaaatcaaataccattactgagtattgttattaggataaacatctttccatactttggtgaaattggaaatactcttgcagaagtgttttcatctctcacccagaaaaagtaaataatgaccttcttccttcttccacttaatgtaatatcctacatttacatatatt

SEQ ID NO: 2029 - DNA, 385 bp, Homo sapiens
atgttgaaaagtggggcccatcaatgcctccctacttgttgagtacccacggcactccagggcagttctgttttcagttgacaaagcccaggtccagacctgcaggtgggctctccaaaggtgacaggatgcgtccttatatgatccagtgctgtggcaccaaaggattatggccaccggatctcaatgacctgggatcaagtcccaaccccttaccaagtggacacccggagtaatcactcaacatattgtagcttacattcctatctataaaatggcaacagtagggataagctttttccctaccataggaatatcatgaggatcaagtgggataatttaatcggcacaggccacaagtactttgtagtcaaataatatttgt

SEQ ID NO: 2030 - DNA, 424 bp, Homo sapiens
aatgagactgtgctattcactgttcttttaggaatctctggctccccacaaacactattttgtgaagacatgctccagaccactgtgtatgccaatatctctttctccccagagcactgctgacacccctacacaaattaatgtccccatctctactgatacatctgataggtacaaacgatgtgtccgtgatgactggtggggctcatgtaatccccacctaagaaaagtagaaagtgcaactttatcttttaggttaataagtgctgagagatggaggtttttccttctcattttgatggagatgcctagaaaacctcgcctgacactctttgtccaacgcaggatagagaacatagcaacagaaagggtgaggcaaaaggcatggctggtgaagaggcactgcatgttatcaggatgtggg

SEQ ID NO: 2031 - DNA, 385 bp, Homo sapiens
gctctttctagaggcattcacggcaatcaagccttacagcctacctatttcttagccgtaatttggaatcatctgtcttctagcccataccttcaactgccaggtctgtaaggccctcaaggtgccgccacctatgcagtcaggctcctccatgccatgccttgcagtggcactccactcagcaaaatgatgttggggccatctacacagcaggggtggagtccatggagaaggggaagggctctgaggtgtgattacgaataaacacagtccacggggctgagcatgggagaatgggggtattccagacacaggaaatggccagagcacagtcaggcacaagaatgccgggtgaaatgggtgcagtcgtccagccggccagggc

SEQ ID NO: 2032 - DNA, 433 bp, Homo sapiens
tcctttaaagcacaacagtttttagttttggtgaaatcccacttacctacattttctttttgcttgcacttcggtgtcacatcagcatgatgaggcctcacagggtggcaggggctggaggacgctctccccactctttccctgactgtagccagcacactccacggctcaggctggcagccagaagtcagtctcttctttttctatttgaaggtctctgttgagctatggctgatgtacaggaacctgcatgtcttcagatcgtacaacctgagggatgctggtacgtggctgtgtgcgtaaaaccaccctcctcgtcgagacggtcaaggtgcccgcacccctcctggagcctggggtcgtgcccctctgtaaaacgtgctcaagtctttcccagcttcacagcgcttccctggcccttccttcccttctt

SEQ ID NO: 2033 - DNA, 368 bp, Homo sapiens
cagtcagaaaggccatttatttatgtttcaagatgctcactgcctcctttgttttgtctcctttgcaggccttctctcttaggcctcttctcctgggggtatggatcctggggggagattgatcacctccatgcttccattcctccccagccatagtggggacatcatgagagaagccaagccactggcccaggatcacccggcatttatggtggctgctctggcacaggtccttgcctttatagcccctccagtgatccataaggccctctttctccccaaaggagaggtcacagatagggcaaaggtagctcttctgcttccagtgggtctgctggtgtctgaccagcctggaaaatgagctgaaa

SEQ ID NO: 2034 - DNA, 368 bp, Homo sapiens
aataaagcctttttggtttattgcacatcatataaaactgactgcactgtatttgaaacagacgaggacattcacaaggatggagaaaccaaggtttccttctttcctggccctcatcttcctccacactgctcctgaggctggaggcagctttaacccaaagaatggaatccgctagtgaacatgtttgttttgtggtggcatcagagttgttctgggcccttgtgcactgtccagtttggagactgctggtaacaatgacaagtgtccgggtagcacggctgggtcaggagaactgcatctgggctgtggcagtgcagggagcctcaggacacctggtctcaggctggcggtggctggggttggcc

SEQ ID NO: 2035 - DNA, 377 bp, Homo sapiens
tcttttaaatataaggttactttaaaataattctttggttaaagtataattaaaataaaaagtagaaactcctccaagcctttcactacagagtgaaaaatacgcccctctttcagccatcagatggccatttaatcagccattcagattctatgaatctaaatgtaatggaaaacactgtaatctgaactccatactggggtgaagcaataagctcctagctaccaatgcagtgatggtgaagagagcctgggaaaatgaaacccccagcttatgcattaaaatgtgccaattactctggtccatggaggaacagacgcggtattttaaaatcacaggaaacaaagttctgtctgtgaataacactggggcattac

SEQ ID NO: 2036 - DNA, 465 bp, Homo sapiens
atacatgctgagtttattgccatataagaaatcaagagtttcagaagaacacacaaaatatatacagtgaagaccttggcagggctgaggcaccagtgctgtgtacatcctctccccaaattctccagcagctaagaaggcacactatgagtgaaggcacagtaagagtcaaagctcccagttaactttctaggtatatagataacagtgaagactactctaaagactactctactaaaaaacagagctgtgagaaggatgaaggtgtctagattttctgtataagtagaactgtaataaatgtatgaggttctatttcaacaccattcccctttattaactttctatttgtatgcccttgaccaaagagtaatcttccaggctttggggcagaaggctgtcatggcatagagacggagtagggggacaccaccaaaacaagatcacattatcatgatcacaaaa

SEQ ID NO: 2037 - DNA, 351 bp, Homo sapiens
ctatttttcaatgagtcacctcttcctatgaaattgaaaactggtcactttcagaagctattctgcctatcaatgtagcaataagtttttaaaaaagaacaagaaatccacttaagtaattaattggatagtaaattgtacatacagaaactagacaaatggaaaactgccatattcttttcagtagttagggtactggtctactggtacagactgataatatatactgtacactgtaaccacggcaacctgaagttcaactcttcgaatcccaagaaatgtaaaaattgttttttggatttaaaaacgttaagctgagaaagagtaacactttcaagttttcattttgtg

SEQ ID NO: 2038 - DNA, 391 bp, Homo sapiens
atcagtgttctctcaagttggttgagatttattgctcgtcttgcaattttaccataattatcaccagtttagtttgcagttaagttactgacaatccctgcagttcagaatgacagaatttacatcaacacaaatctagtcatttaactagattttgaaactcctaatgatccaaatgagtaattcacacctattactgaagcagatgcacacataataaaaaaccatgtacctgtattgtatttcatgcctgcgactgttagtctcttgagtgcattttaattagacttcctttcccactagtgaaatccaacggtagtcaagtttaccactatcaggcctcatattacttaagtactttgcaacaggtaaccctgttgactacttcctc

SEQ ID NO: 2039 - DNA, 390 bp, Homo sapiens
gtctttttgtgtacttccagcataggtttggatatatgaacatttttcttttattgttttatcttcacagaaaataaaaggtgttaatttgctttttaaaacaaatttaattatcacattttaaattactttgtggactgtgttttcaaaactttgcaaattcatctgttacacagaaaattttgacttaaaacatctgctgaattccaaatttctgtaatagctactgtatctgtgataaactttcctatatctttccttgccatttctatggattttataatgaaagaaaaaggcattggagactgaaggcagaaatggttgtgacagtgctgtttggctttttcattcttcaaatgccaagtcatccactttgttttcctgtttagg

SEQ ID NO: 2040 - DNA, 408 bp, Homo sapiens
aacaaatctgcagtgacttttttatagtttccaattctatatggaaattttccatcttttatctccttgaatacagtaaacatacttaaagtctacctcacaatgcaattatttggtgcccctttggtctactgtttctgccagttttcattccgcctttctcctcctgtatccagggtatgtggagatactgtatttgaaaaagtacccaaataatttgaggcctaggaaaatattcttcctccaggtttctatctttcaggttcctaggggcattagaaacctaaggtcaccttagtccacttccaaaatctcacaatttactaatccaccttgatgatttaatgctaaactacactctatgtgaatggtctacttctgtttcaccattatccctaggatgctgtc

SEQ ID NO: 2041 - DNA, 393 bp, Homo sapiens
ctttataggttatttaatcactaatctcaatgaatattttatctaaatttaggagacatagtagcttcattatttataacccagtagtcatgtttcaaaatcattattgcaattactttttgattctttacataattaaagctctaatattccatcttgcccagaaggtcactactaaaactcgagacaagataattgctgaaattttaggtgggtgcttaaggtacatcgagggtcctggtggtgaccctagccagagcatacctggcaggggaagtgttaccaccactgctgggagcaggggagccagaggcaaaaccagagtccaaatcctgggtgagtggccagatgctcagggcgccatcctctcgaagataaaggccagccctggag

SEQ ID NO: 2042 - DNA, 353 bp, Homo sapiens
gcttttaggtatttcatgtttgatgcgtttggttccagatacttttgttttgttctcattttcctgtgaactgttctcctgtttccgaggtttgattggaggcaggggcttatcttcttctcctttaataaatctttcatatggtaggattaatctttcataatgtctgcgggtacaagtggcagcgctggtgctcccaggattaccgcctaattcatcataaatatgtttccactgacggcgggctgttattgtttcatatcctcccagtttttgagcagcttgaaacatagtccaaaggttaatctgtttaaaacctaaatagggtattcgttctatcggcgttttccttt

SEQ ID NO: 2043 - DNA, 388 bp, Homo sapiens
agtctcctcaaagtttagccaacttgtctctggaataaaaagtgtaggatggatttacctggttcacttaatatgctttttggatgactatgaaaagattatctagtgtctacacttcctggaataagatgagaaccttatgtgttttccatgatcaaagtgtttaacaaaggtcaagttacttcccttgcacttcaaaaacaaaaaaaaatctagatactttggtgaattatttaatgtttttcactttatgtaatatcaaaaatgagttgggtgggggaaaatccattctttccatcatatcactcacctcaagacagactcagtcctgtcctttgttagcctccttttcaggatgattgtaacacatcacatcagtattcatagt

SEQ ID NO: 2044 - DNA, 371 bp, Homo sapiens
ctataattagcctaacgttgaatttcacagatataaagatctaaattcaagttatgcaaacaactgatcaggcgaatagcaaggatgtaaagacaatggaaaaattttgagaatgccaaactctgtgtacacctggcacttccatctttcctgcaactttctgtcttccttcttcaatacagcattccagaaaaactcagcttgcacaccaggccgtctgggcattaatacctctctgcctttgctcatgctatttcctctgttgtgatgcctttctcctttccctgtgtctatctaaaccccagtccactcttcaaggaccattcccaagatgaaaacttccccaatgactccagtacacactgactggc

SEQ ID NO: 2045 - DNA, 353 bp, Homo sapiens
tcacgcacacacatcaccccaaggtggacacacagagaagggtctgagaaggaactcatgtaaccaaatggaaccatgacataaccaaatagcacctcctctttttaagaggctggcagaggagcccctgcttggtgtcctcctcactggctctttcggagcccacctcacgcctcactagctagggggtcagcagccaccaggcagatggacagccccgtctccacactagaggaataaatgtcagcgacacgatgacagcagagaacggtcacataccaccttggaactggaaatataggaggaaagaaggctttttttgctgacaaaagaaaagtcactgtgataactgt

SEQ ID NO: 2046 - DNA, 397 bp, Homo sapiens
aatagcaattcaaagattttctattccttagtacaaaatgtctgcgagtcaatccatttcctctttaaaatatttagacatggtgaatgtgaaagttctacccaaaaagctttaaagtttatatcatctacttccaacaataggatcaattagcattgaaagtctaaaaagtcttttaaaacaaaatattaattttaatgacaatcctaaaatcaactatgcctttaattttactaaatacacaaggtcaagaattacttttccattagattccactttaagaaattccaacaggaaatgacaattgctaggaattaccaaatttggcaaggtgttctttgaaaagtccacaataaagcaccatgttacaaagtttgataaaccaaaaaataatagt

SEQ ID NO: 2047 - DNA, 505 bp, Homo sapiens
gcttttctagtaattcatttttattgttctttacaaaaacatctggctgtggtaggttgggagagcatggtgcctgccccggacattgtctgcgggacaccttcatcgttagggtcacagcgtccaggcttgctcaggacggtcttgggcgatgtctatcccgtgtagttagataggatccctgtccctctcaaaaagtgtcccaaaagtgggagtaagagttatatagtcactgtgactcagccagtgcaagagctggagctccttgaagcccacagattttcagtctcaggcatccttgtgtggttgccatggccaccaggtgtccaataataggccttgttctcccagctccggcccacggagtgtccataccttcccccaccaccctgcccgctgctgactgcagccagtgggggccctggggctgtcccaggcatgagcaaggtccttgggcgctgtcccaggcatgaacaggggctttgaggccgtcgccagcgtggtg

SEQ ID NO: 2048 - DNA, 463 bp, Homo sapiens
aacaagttcctgtttcacttttccagctagctgctgggtatctccaacaaaatatctcatagatctctcaactgtaatgtattcaagccaaaaatcagctctgcccattctccatcccaaagcccctcctcttggttacctgttagtggagcaacatcatcccagtcaccaacacttggcaactgattcttccccagcatccagtccccatatctagacgattgctaagtcctctgatgctaccataataccttacacatcccacttcctctaccctgaatgcagtttgtattagttcctgcctagaattctacctaaactattacagcaccttacctactgctttcccttccccagtccttctgtctgatacagatctgccttcagatccatcttggtgcacattcctaaccaagtcacttcctggtgcaacagaatgagcatgggctttggaactaaacaa

SEQ ID NO: 2049 - DNA, 411 bp, Homo sapiens
gtgctgggattccattttattgcaaattaaactcaaacccaggggtattaggaaaaggctagccctcgcccctctcactctctaactatcctccctccctccagatccccaggatttcatggccagggctgacaggagggaatgggaaacccatgggctctgaagggatgtgctccccagctctgatgaggcctaaactgcttcccccaggaggtaaataagccaacattcctgggttgggcctcgacgccagtccttggaggtggcaggtacagcactgtggttttgcagtctttggtcttaaaggtctgaggcaagggcaggggaggggtaggaacttggagagcaactggactttgaggaagaaaatatcagaacaaaaaaaaaatccagcccatctggggctttttt

SEQ ID NO: 2050 - DNA, 399 bp, Homo sapiens
atggctatggataatggtcgtagatatcttacaatctaggattattttgaaaacttttttctgagttattcattgtaagactctccccaatccaagggtgaaggatacttggacacaacacaatgccagttcaagttcaagggaagtgttccatcctctttcagcctccactcagctccctgacacacggtgcatggtccagctccctgggattttcccattcggaaagggaagccgtttgtcgagccagcctctgtgaccactcatgatctgaattacccacaggtgttcgaaaatacagagggatccagcataattaagagcattaagcaatcatctcagcccaaggaggcagttgaagaaaagaacagagtttgggcaacacttggggaaataaat

SEQ ID NO: 2051 - DNA, 369 bp, Homo sapiens
acaatatatgttttttattcttttcctagaacattttcttacataattaaatacaaaatgaggaactttcatatttctaggaagtaccacatacaatgatttccttaaaatagcttgctactaaagctagagtttagcagataccacttctttctacttttcaacattatactttatccttgctatccctcaccattctctcattgatctacacatgttcaaatgtaaagaaatcaccttagctttttcttaaaatacgtgatagtgaagagatgatacagttgccagaaagtatcaaaatcaagactgagaactggtatagtgggaataaaggccactgaagtaggcaactccacctcctcttgactt

SEQ ID NO: 2052 - DNA, 398 bp, Homo sapiens
atggatgcaggtatggggatgctagccgtcctcttccacaccatacagacagcctgtcagtggcagagtaaggccagcatgcaaatagagcaaaggtatacaagccaagtaatatcaagacaaaagtcagggattattacactctgagatcatttgagactctagatttgtctcttaaaccaaaattagattgtgttagccaatgactacattttcccctcttaaactagattgagttgtattttgctacttgcaataagaagaatcctaatatacttatcaaattgccagtgttccaaatttaaaactttaatgatgataaagttcaagaaaatgacactctaaaatacaactaggtcaaactttctagaagataaacaggcaattacattgaaagc

SEQ ID NO: 2053 - DNA, 415 bp, Homo sapiens
acttaaaaaaaagaagctccagaaaggaaactttgaagcaaaataaggactccctctccctccagaacataaagaatgaggtgtgttttgtttgagttggtggcaacatttaaactcttgtttatcccctaggaggtaaggagaagatattttccaattttcccaaacagggtgttatgaggtaaagttctgtgagagaaaggtgaggcccttaaatctgtcaaattattaactgatttttcttctacaggtggtgattttttgaatttcctatctttgtctttagcacccaattttagagaccaaatggttggtctaatcaaatagttattttgtgttatccagaatgacccctgcattccactctccagtaacttcctgaagcttttatcttgatgtaaaaacagggcagttt

SEQ ID NO: 2054 - DNA, 342 bp, Homo sapiens
gctttttaatacaacatttatttatttaattgttttgagatggaggtcttgtcatgttacccaggctggacttgaacttctgggctgaacctcctgagtagctgggactacagatgcgtaccaccacacccggcccggcatgatataaacacttaaacaaaaattttaataaggattagtttttgttcatagggagaagggcccatgaggcgaagtgcctaggtttcataaaagtcataatggaagcccagggtgacagctgtcagccactgtgggctggggcaaggagaaaagcctatgggagcagcttcttccttaggggttggctgaggggaagagcat

SEQ ID NO: 2055 - DNA, 350 bp, Homo sapiens
gaaatttgcattttaatcagcgtttggctaacaatatgagataaactattagagaagtgtaggtcattctggcaaatagaaagttccatcatttcacacttagaaagctgccacgaagagcttattcttggagtataaaatgcagaatttaggttaagccagtcattttgtagatgaaattgtacactggcaatttcttatggttcaacctaatagtaaaacatttataaacaattgtatcattacaaatacatttagacatcgttttctgctaaactcagtattttcctttccatcctgatcaaagaaacattattgcagtaagccacattataattcagcacgatttc

SEQ ID NO: 2056 - DNA, 480 bp, Homo sapiens
gctgctacatattttcagctttattatttcccagtattaaatgcaatgattttctaaattcatggatgtaaaaactatgcaccgaacaagatgcaaatataaaaagtcttatatacccacacctagttcctccaaccatgtctcattgttttttaattccacccaaattgcttagtcaggaattatctcatttcacaaagaaataaatattttaaaacttctgggactccatattattttcacaaaagtctcagagttgaagagacaccaagaaacattgaaattccttcataacttcttctactttaagttttagggaaacaaatgagaacgccatcatttttgagaaaagcaaatcaattcctcctctttttctcaggaagaaagagatttttagtttggcctctttcactatttgtcagttaccaatgttaactccttccttcattaacagtttccatatcatcaaataaagcaaca

SEQ ID NO: 2057 - DNA, 386 bp, Homo sapiens
caaattctcttttattgctttatgtccctgactcatgcaggccaaagggtgaggaggagtaatagccaacaagagcgtcctgcagaaagaaacaggctgcgtgggtccggaggagcttgaaaggaagaacccgaccaaagggcaggagacccggctctccaggtcgcggaggcgtgggtgcccagccaggcggagtgcggggcggggcctctcgggccgcaaggtggggcctcctgggccgggaggtgggaggtgagctccgccagcccagcccactgcagacaggttacccaggacctcaaggtgtgctgcgtcaccccgcccgcgctgcgctgattggttcctccagggagcccccgccccctcagctgtaaccgggccggctt

SEQ ID NO: 2058 - DNA, 384 bp, Homo sapiens
ctcataatgtatctagcagtatattctaaaattcctgaaagtatagggtttttctggttatctctcgctattgattcctgaattaattgctttacggttaaagaagattatttctacgttactaatctaaaatttgttggcttgctttaagactctcataaatattccatgtgtgcagttgaaaagaatctgtatttcacaattatattatatatggtcattaagtaagcttgttggtaaattttctatgtctttatagacttctatgtttccttcattcatcagttccttagaaaggtgtatttagatctcccactatgatgatgtttgtcctctccaaacttcatgttgaaacttaatcccaaatgtggcagtattgaaaga

SEQ ID NO: 2059 - DNA, 422 bp, Homo sapiens
gctggattaactattactgtattatttcctcttctcccctcttctgtggccttccattttaattattcataaatcctttcagaatattctcagggagatccataaggggaagttctggagatgtaaaatccaagggaggaagactggggattggaatgtccttggctttcccggcatttgctgcaaacttctgccaggttgaggaggctgtagcagtttctgaatgtggcggcaagctccgtaattctgacgtttctacaaaatcagcatctacatccagctccttttctactggacctttttagaagtctggccttttcagcctttagttattttctttccttaatctttcattctcagccacaaggaattccacacgtctcttcaaatctgcaattttggttgcctattcctctataatt

SEQ ID NO: 2060 - DNA, 369 bp, Homo sapiens
tgggaaacatgttttatttttgccatttagctgtgaaatcatcaggatccagacataagatagtgtaattattctgcaaacacccagtggacagctcttgtgtcacccatagcacccgagggtggtcaaagtggctcattctggctcttccaagaaatgaatccaactggtgacaggggactcagagacaacttctcttctcctttcccacagggagacatctcctgcttccttttccagggcaacgtaggctgaatacatcccaaagtgctcagatgagctgcttggtggccacaggcttaactgggcctgggccagccaaggaccgaacccaggctgttgggagacagcttggactctgtttcatgc

SEQ ID NO: 2061 - DNA, 443 bp, Homo sapiens
gccatcatcaacacttatttaaaaagtactttaaaatcattcattttctgaaaatgcttttcattattttccagggtccataaaaagcatagcacggggacgaaaagcttttctaagccagcagtgtttggtgaacactaacaatcccactggcataaagttaaagttttatttccttttttcttttcttcttaaaataaaattaaggctcaaatgttctattaagctctcattgcttatgtatattatattaaggcttataaatgcacctggtaaattaaattcaccctggattgaattaacacctgctatatgagttatttgctttatgtaatcagtaatctcaaggtttctcctctttctctggaaacacaatttaaatattaacctaatctttaaactgcggctgcttctttctgacatttggaaactggtcatccata

SEQ ID NO: 2062 - DNA, 352 bp, Homo sapiens
ctggcttaaaccccaaatggccaagatcccagtctgaataaacaatgtgggtggtgacttttctgtgaggcccagtagaggatgcaatcactttcttattcggttcaacattaaatcatgtgaaactagcctgattactccacacaacttttactccgtaatggagggcaacacaacatgtattctttctctgcttctcagggagaaagaaatgaattctcctaactgggagtgtttaattatgtataaagttcgttgacctcacaggcggctgtcagatgatcttgctaaggcctgtgaacggcatcccaggaatgcagtgatgtgggcagaaaccgagtgagttcatgcc

SEQ ID NO: 2063 - DNA, 334 bp, Homo sapiens
aacccaaaataactttattatcgtctccacttttgatataaaagcattctccaaatggggggcaaatgtggcaagtcactgtggagtctgggccccctgtacacccttctactccgaggaataagccctgtgcccaccccagttgcccattgccatgtcctgccaaccccctgccccccgccaggtcaagccacagtgcagtacagaagtgaaagcctgagattggccagacacggtgaccacagggcctcttcctgaccttggctgtgggggcagggggattgcacattgcagcttcttgctgtctccaggaaagactgagtaactggggggc

SEQ ID NO: 2064 - DNA, 378 bp, Homo sapiens
acaatttattctaaaggtaaagatcaccctcctcatttcgcagaagagaaagctgaggccactcagcacccttgggccttaagccactgccaggatggtagccctgctggtttttactcccatcccctccctgcaaaccagcaaagaccacaggtagagctgctggggaatgctgagcacaggttgggagcagagggcacctgcctactggggaagccctgaaactacaaatgaggcaccttctctaagacaaatcacacacaaatagtcctagtgctgggatggggacatctggtaaacccccatcctgggtttgcacttctccctttgaccttgtgcctggggtacggacccaagccagactcactcttcatatgg

SEQ ID NO: 2065 - DNA, 342 bp, Homo sapiens
tttattattttgaagtaaaatttatacatagtgaaacgcttacgtctttaacatactatttgaggagttttgacaaatatataaactcttgtcaatatataaactcttgtcaatatatagagtattccaccaccccaaaacatttcctaaagtctctacccattactgtctctactccacctggaaacgcagagaggcacagccctatctcttgcacccataaggacactcacagcatagactgggcgagggccagcatctatggactgactgcccatcagggagggcttaggcctcagccagctgctgcagcaacgagagagtcccatagagggcagacag

SEQ ID NO: 2066 - DNA, 438 bp, Homo sapiens
cacatcataaaatatttattaataagtaaaatgattttcccctgcctttggttattaaaaaatgagtatcattgatgataccaattgccaacactggttttacattattcagtcatgaaacagaatagaaagatgatcgatagatatctatagacataaatgtgtagaagaccataccatacagcaatttgtttaattacaaaatactggttgtgctagcagttggaaatgtacttgcacatccttaaagttatctttttttatataagtaaagaacacacaaataaattcacttgaatttgataatttggaacattggcaatgaatacagtgcctgttgaggcctgaaagagagaggaaatcaagaacagtgtgggagaagaaaggcaatccttcgttgaaaagcttttctcttaacaatccttagtgcctgaaaaa

SEQ ID NO: 2067 - DNA, 334 bp, Homo sapiens
cccatgctcccactggtttatttcaaccccaaatattttccaacagaagtagaaaacagggcatattaaacaaacaacaaaccaaccaaccaacaaaactaaaagtgatactgacacagttcaggtgataagcaggaaaatgggattatcagacaccggctctttggcacacactgcgaagtcagcccctctgcccagtctggaaaagcaacggcgtaagtcaatgtgatgaagaggtccagcctctcgtcgggaacttggccgcaaaatgggtaatgcttttctgtaggatgtggattgtagctggtgttgcaatggtgttttgctcagggct

SEQ ID NO: 2068 - DNA, 427 bp, Homo sapiens
atttaaataacattttaatgacaaaatttgatgctctcaagtatcaaaatggaaataccaacagcaaggtttccagggatgtccaacaccacagagcagggaggcctggctgggcctccactgttgaggtcatcatggtgcttccgctttattctgattaacttttggttacacacattgaaaaatgacctaagagagttgttttgagtggcgctttttctcattgtacagctcctgctagcagtttactgcaacactgatttctctggaacctctcagtttccagtcatcattagggctgttactagcaaggacctacaagccagcctcaaaatgtgagagggctgccgacagtcttcctgtggttagctgccacagtgcccagggaccatcttccctctcctcctcccccactgccagctcctgt

SEQ ID NO: 2069 - DNA, 396 bp, Homo sapiens
aaaaattatatttaatacaagtgaatagattagaagatctgaaatgttataaagcaatatacacaacgaataaataatttgcacaggagagtcatgtctacattacataacactgtctagtatgggaatacttaaagtaaatccagtgataatggagaaagtccataaaaatgctaacctgtcttcccttgtatgaaattgttcaagtataaaaatccaatacagtgtaaaatagtattcaatttagtttaagaataaaaattgcaagtattgcagtttcagaagaaaaatgtaaagcagcatttaaaaactacataatagtgttaaactaatgaattaccaataaatgaaatctacacaggcaaaatcagaggaggaagcatgaaactagcaata

SEQ ID NO: 2070 - DNA, 369 bp, Homo sapiens
actttgccaccaaatctcagattattagaaactaggtgtcagggtttatcaagaaggccaggaaggccttttgggttaagccttacattcatgaagaacctcgagggtagatttttgagagcattccaaatgaatggtctctggtcaaatgaatgaatggtcaaatgaataaatctgccctcacagagatacaaaaggaaaaggaatataattcataccatttggtttaagccttacattcatgaagaacctcaagggtagatttttgagatcattccaaatgaagtcgaatctgccctcacagagacacaagaaaggaatataattcatacactattgcatttttaataaatcttttgaaatttgcag

SEQ ID NO: 2071 - DNA, 381 bp, Homo sapiens
gtgaatgaggacgaagatactgctatcaaagccagccagcccagatgtgctgcactatcctctttctgtgagacgctgtgagcacctacagtcaacagattatttattaggcaagagaagcacttaattctaacttctggctagcaaagcatcctcctttccctattactggacaattactttctcagatcccctctttcaaattaatctttccctcatccatggtcctctctatcccagttgtcaccctccctgtcttctggcagtagacaacaatgcccttggacagtccacagcacaaacactggccggaatgcagtgctgagcgtacgtgggccgagcacatccaccgggctggctagcagggattgcttgttttca

SEQ ID NO: 2072 - DNA, 407 bp, Homo sapiens
agtgttacagacagatattgtgaaatttttccttgggcttctttcaatttcgttcaattctcgtccagtattctcataacatttggatcaggtactttatcaccttgtagtgtcactgttcctttctgtatcctctcgaagcctcctgttactcgttttctaattctcttccagcccactgcacgatctagtgtcgaatggatgaaacagctgagcagaacagttctttagctgtcggcctaaatgaccaacttcatgacctctcaaggtctcgctccccggctgcacgcagctcagcttccaacattcgggaaaggcgtgccggatcgcgaggggccgctgggaccgagtccggacgtcgcgacgcgcagggggctgctgggccggcggtctcgggaaaagtgagg

SEQ ID NO: 2073 - DNA, 343 bp, Homo sapiens
aaaaggggtttctctcatacatatggttctgcaacatttttgtattttagcaatacattgtgaacaactttgaaagtgaattcagacatcagcctccttttaaaaagctatactattcactggccagatttaccattctgctattaatgggttgtttcccaatgttctgtatccaccaacactgatgccataaatattctggcatgcaactcttcacacattaacatttgtagagtaaatattttaaagtgggtggggtggctggcccagggaccagcctgtaaacaccaaatctaattaccttctctcaggtcctccttggcctcaccctctacatttcatg

SEQ ID NO: 2074 - DNA, 399 bp, Homo sapiens
agcaaaggtaccatttttcacaggctattttctactttcataatcatctcataaaggcagtataggttcaaaaggcaaatttttaggagacaacctgatcagccaccaagaatcgtttttgatttggtatcaaaagacataacatttgatcagtttgcaattttgtttgggataaatatccacagtgatactttgactctgaaaaaacatcaaagtgccgctttgggggagatcatgaaaacacagcacgcaggcctaagagttgctaggaaggctatgacagacgggacagcagcaggttctctctcaagactagaccgtcaacagagcatgcagagaaagaggcacagaggctgttgcttcacaaaactgaggacggtcaggatcagccaccaccac

SEQ ID NO: 2075 - DNA, 387 bp, Homo sapiens
aacttttaatttctgatcgagtcacagaaggatttgttgagtagcttcagcacttcttcctttgtcatttttttctgtctgataagtcatgccatggacgttacccatttttatcccagaggcctcttacgttgacttgaaaagacggactatgtctttcagagatcttgtgggtatcacatcaatcttgacaaattttctaccctccaagtcatgatcctaagaacagcttgcctcccatttctccggtttgtgctattatgaaggccttattgtttcagccttcttcaatcttgagggttgttgtcactgtatgggtggttcagaaataagtaggtcctgttactatgaagggggtcacagcttttgttggcatagctaaacttt

SEQ ID NO: 2076 - DNA, 392 bp, Homo sapiens
ttctgactttttattcttaattgcaaatgcacaaaaaatattctaaacataacaatggccaattttcaatcatatgagtttggcagtggttaacttttcacttgataatttttcttatgaccatctgcaatcccaggggtgcattttagcttgaaaatagcaagaacaaaaccccaagaaatcatggtttcttagtccatttgtctagcacacaactctctttatatattatgttttctgctagtactcaagaaatccttcaccattaaagcagctgccagtggggaatcgtgtacctaaagtctttcatgttaagtagttttgggcttatagttccagtatctagaagaaaagtgtgaacagaatagaagggataaaagagaaaggaaagt

SEQ ID NO: 2077 - DNA, 402 bp, Homo sapiens
aggagaaaaccacttttaattgaaaaataaagcaatacatctcaaataagactctgttttaacaataaaactgtaatttgttgaaatagctttcctaagtggtattgtgaaatttaggtattggagtatcaatacaattccctcctttaattctgactcagctataagtaatattaaaaataaaaacttttccccataaatttaatttccataaatctgtaaagtctatccctattcccaatgcactgacaaaaagaggggaaagtttaaacaatcattttcatactgagaaattctcagataaaagcaaataaagtattttccttatgaaaaagctgatatgtgagacacacaagactatcaatgatatttaactcattcacaaaactttaaaacacaatt

SEQ ID NO: 2078 - DNA, 465 bp, Homo sapiens
aagtttaaatgttaaaagtcatatcaagaaagcaaatacagaattgcagttaatatttacaaagtcattatgcagacacactattacatgtagacagttgtagttaaaacaccttgggtatttcatttctaaagcgaagctccacaggcacattctgtttaaggttcttttcattctctcaaaagttataagcaatggagtgtgtaagttgttttaataatagttcagttctttatgtacattgtaaaaatgtcaagcatgttgattcttcaaaaagttgcatttcacttagcagagaaaataaaaatgtcccatttctcccgagaaaaaggataacattttctaattgtgcaaacactttatgaaagtatcacttgactctatattttgacagctgctttgcatttattattggagaggctcttcatacggcatgttcctttttttttccttttctagtcaaga

SEQ ID NO: 2079 - DNA, 409 bp, Homo sapiens
gcttttggggggtacctgtgacaaaaccaatgaaatccaaagcactgtcagaaatggaagatcctcgggggtcaattccttcatttcacagatgggaacaccgatgtcttcttgcaccgagtcttactcaggtcacacaggcaggagttgggagatttggggctgtaggagaaatgttataacatcatcccacctggctttatccattaacatctgctcatctctgccctcagggagtcgtggagctggttgaacaataccagacagtacgtggagagccttgcattgtgttcaccacctcgctcatttttattcaaaatgattccagaaaatcaatgtgaccatctggcctcggagaaacttcactgaggtcccaaatgtcttcagtgcccagatgaatccttataac

SEQ ID NO: 2080 - DNA, 451 bp, Homo sapiens
aattttatagtctttattattgaaacattgcgtttccaaatcacagtggtttctactgacaaagtgcctacaattcatttctttattaattacaaacatttcagagtaattacacagcactttatcttgtgccagccaaacctcacaacaatgctaggaggtaagctgtcacacctacagtttgtttttccctctaaaggagaaggcagggaaagaaagtcttttgcagagttatacaaatatttggcaaaattcagaacaaatctgagagggctattgataagaagctcttttcattatagacattcattctatccatgaatgagagaaaaaagagaatggaagatttatgcattacttcaattggagaaatgagataggagagtggctaacacaaaaatccctaaatattgttttagaaagtatgaaaagtggactgggtgtggtggct

SEQ ID NO: 2081 - DNA, 416 bp, Homo sapiens
tttctataggagaagttcctaaaggaactgaatcaaagggtatcgtgggtttttatttttaaagacactgccaatgtattttcccccaaggcagcaatcatgaacactcccaccagtgtcctctgggactgcttgcttgcctgcagccaggccagcgctgggcattatgcctcttgtgtacgtgtgacgacagtaagggatggaaggtgacgttgactgatagggtttctcagcggaaatgcagctccacacagttccaaaaaacactgccaattccagagcattctgggcccaaatgaggctagaggggtgtgggggagcaggctgtccactcagggggccctgagcaagatggggacaccttcctcccaagcccctccccatccttgcaagccgactcctgagcctgcaccatc

SEQ ID NO: 2082 - DNA, 494 bp, Homo sapiens
ccgtttctttggtggtggctcagcctttacttttggctgtttaactttgggtttcacggaaggggcttttgtagttgtagtttttgatgctagaggatcagaagttttactgctactacttggcttagcttgaacagttctgatagtttgtgaaggtttatttcttggctttttagaacacactctgacatattccttcttgtttgcattttcaatgaacttcacatatattcttttgtatttactctttgcatctccaaaatatccaagataactatttgtagcagcaaattctctttgaccatctcgaatttcaggaacaaatttctgtaataaagctttttgtactttccaaatagctggaggttcttttcctgtttttaaagcctccttaaaagtctctatgtcttctatctttaccacaaattcatcacgctctctgtattggccttctcctccgctttctgtgtcctcctcatctgtaaaaccttcta

SEQ ID NO: 2083 - DNA, 415 bp, Homo sapiens
cacccaacatgcatcggatttacttgagttccaaatgtgtttgaggaaaggagagaataaccatccgggacagctgttgccctttctccacacaggagctgggggagccaggtctgcggcccccttagccatctgtcggtcttggaggcagggctgcctgagaaggggcttttggggtttccacatctccccatcttgtccactgacctcctccagcacctgccccagtcgctccttgcgggaacctcctggggccccaggacggagaccactcccaggctctccacaccctggagccagccctaggcccaccttcctccccgctggggccatgccctccatgcaccctggcccagggtggggccagcccccaacacagacactgcacccaggaacacatgagcatctggtccac

SEQ ID NO: 2084 - DNA, 418 bp, Homo sapiens
acagctatgacatttcatttatttctctatataatgcaataaagtagatggattaaccgtgacgtttacagatggagcaggggagaatgaagaggcgtcagtttgggcatcaggctggatcttcacactctgacctcactctgctctatcctgcccagtgttgcttcacctgatatcaggggtgcaaggcaaccagatctgacaccagtttcagtttagatcctgcctttacctgggtgtgacccgggtctatctcttcagctcggcctctgctttctcttcataaacttttggggttagtcctcggatgatctctaaaacatggcccaggtgctccttgccagtagagtgtagccggatttggagggactggacactcagtgtgaacaagacgaaggcctcaggaggcagtaaaagc

SEQ ID NO: 2085 - DNA, 507 bp, Homo sapiens
ggttagtatgagattttatttcttgattatgagcgttaataaaggcaagtgttggctgagcctggatgaaatatgagatgtttataacacacacacaattgtgacaattcaaatgcagaactttttgtttaaacaaatgattacggttgaagtagaagtataagcagggccataattcatgacacatccaattctttttcctgctgcagtcattagttcttcaccttcgcagtaacaaccatatgagtgcaacgaaatagaccatgactaaaggatttggtaagatcttgctctctaaatgatctcctgaaaatcccagtccaccatttgactccgtggcttacaaatctccagtgcttctccattacctcaaactgcaggcttaattttaatgtgttcattttttacaaggtgtgtcaacgttttatcaatttctgaaaagtgtctatggccccgaaaagttgaaatccacgacattatatcatctctgcgagccctttccagctc

SEQ ID NO: 2086 - DNA, 523 bp, Homo sapiens
gggtgtttgcagcactttaattatcaagagaatataaaaatacattcaaataaatgaagaaaaatgggcaaacaaatggacacatatgaggatttctaaggttcaattaacatgtgagaacttctcaacctctcagtcatcagggaagccataagccattggatccacaaacattaaaaagtctcacaatcctaagtgtcagggagaatgctgactatcagaagtgctgagtaaagctctttacaaagctctcaagtagcatccactaatgccaaacatccccatgagcagcgactccaatcccagctgcgaaatgctcaggctcaactcaaatgagggcaggtgcattcatagcagagctagtcgtgatggccacacagtgaagacagcaaatgcccaccagcggcagggtggttaaatggtggtggtgcattcaccagcagtgtagaccaaccagccactccaggtccactggtatccgcaggactttgcagacacaggccccctataaatccattaatca

SEQ ID NO: 2087 - DNA, 433 bp, Homo sapiens
cacgtaacacaaaagcttttacttggaaactggcaaatactggactagaatactgacatgctcacgctctggcgggagctcggatgcagaagctattgcacaaagcccctctgattgccttgctcctctttggcatgtatcagcagagccccaagggccaattgcccacaggtggggactgttctccatcaaggtatggggacccctacttccttgttttgttaaaaagtgcaggtaggcgaagaagcccaggcagttgacccagtctttgaaacagctgactccccagcacccagtgtccactggcagatgagaggtttgcacctataccagcccttgtttccttggtagggctcaagttgtcagtgtccaggtacctgggctgggccagagctggggccaggggagcctggtcttgaggggtaagggctgc

SEQ ID NO: 2088 - DNA, 453 bp, Homo sapiens
aattaaaactgaaggaccaaagaaacccaaggaattagattcatgatgctacttgttctgcttctatcaccatcaaacattaggtaaaataattcttctttgccttcaccttgtccattttctggaggaagggacataggtttgatacaacgaatcaaaaaaacaaaaaagatcctcggggtatttatgcagtataataaagagcaaagcaatgtaattccaaaaagatagctctcaaatatttgaaaaaaaatcactaaatcctaaaacttctcttggaaacaatttccatgtctcaagaccattacattggttacccttgtaagaattttcttaggaatagtttaaaatggttactttgataatacaaaagatctcacactatagaactgctgaatggactcacaaatcacttatacttttaaagtctaaccatcccaatgtacactcaga

SEQ ID NO: 2089 - DNA, 552 bp, Homo sapiens
aagcagctttattaatggattggagagcacagctgggatctgaggcctaagcaaggttcctttcttcttctgtgaagtgacggctgccgagcccactgggtggggcccaacagaacttacccacccagtcacagacggaggctggaacatggagagccaagtcttggctgagctcaccacgggcaggttctgctgggtctgtttactgcatggagactgactccaaaaggaggaggagcaggggaaatacaaagagcagcagtcccaggcccaacacaaggagcctggaaaaactcttgaccagtgggttcacccgaatatggccagtcagaatgtcgtagctccacgacaaagcacggcgagcctccttcagctcctcttcttcagcaatcaaaaaggcgttttcatctgcttccagatcctcaaatgaatctgtgtcttctctttccaactcaagcctagaaggacagtcaaagagcatgtcaatctcatcgtcatccacaggggtggggagcaggctggcacttgggttgtacactagttcagagatgg

SEQ ID NO: 2090 - DNA, 404 bp, Homo sapiens
caattcagaaagtgtttattggccggagttgtcggagagccaaaagaagcagtccaggagggcttccttcaggaggcagccagcacagttgcacagggcagcttccactgccatctgccagcactgagtcctcctcatccagacacaggactgtccatgggcctctcaggggtctttggggccaggatgggacccctcagacctggcccaggtgggttttcaaagcctgcagctctcggctgttgatgttgttgcctccacacacgattaccacaactgaagtcagggaagggggcaggcagccctcggcctggagcctccgcaggaggcctgagtagatggctgctaaggctgccccacaggcaggctccaccagcatacgctcatcatccaggagctgctgc

SEQ ID NO: 2091 - DNA, 432 bp, Homo sapiens
gcattccagagtttttatttttcttttccaaagaaatatcaccattaaatttccaaaatacttcctattatataatagactcataagattgttatgaaaaaatcatttcaaaaacattaaatgttttcgggggttaaaacatggtaatttttaacaaacaaagtaaaatctagagcaaactgaagcattcactcaaagcaacaacaataaaacaaacaaattcaccaaagcaattgcatgtttttatcagacatggtgatttcaaaggcctcaaggtaggcaattagtaatgccatcatctggtaaaaagagcaccagaaggggaatctagaaccctaggattttgtcctggttgtcactgtataactgacactgtataacataataactgtcactgtataacataataagtcacagttaccagttacttca

SEQ ID NO: 2092 - DNA, 399 bp, Homo sapiens
aggatttagaaatattttttcttttataaaataacttggtatttttctgataatcttccaatagataaataaaaacttttcttatgctacagtacaagttgatttttaaggaaatttgtgcaaacattaagaaacaccgcattggttctgggtgaaagtgccagtctggaactctcttgaaagaccatacagtctactgctaaaccctgggactcctcagacttgcactcagattatcgtttgcctgccctgattttagactctgctaattcaagtccctgttatcttgcttgacatcgacaaggatcaccgcaccgttccttcagtttccacagttccgtcagttcccacggagaatactgaggagaagacagcattcctgtctcacaggtcttctca

SEQ ID NO: 2093 - DNA, 341 bp, Homo sapiens
aaatatatgtaccaaactttaattttcatttcacactcaaaactcctgtagaaaaaaaggcaaagcaggcaaaaaaaattacaatgacttcagcaaacaacatatgaaaactgcaaaacagccttgggtctgtaatggcctttatagacgtagtgagaaaactgggttccaaggttttgaactctttaagacaaaattccaatgtttattactaacatttaaaaaatatttgtagctgcataggatacaagattgaatgagaagtctctgaattctactgcacaattggatcctaagattgggaggcttaatttttctttggggaaaacatgaaattattt

SEQ ID NO: 2094 - DNA, 371 bp, Homo sapiens
gctgacacagccaggctgagacatcaacacctacaaaaactgtgggaaaacacattaaaagtgattagaaaaacaataaaagacatccgtgggtttgtgcaactctctcagacagttttatgaggaggatcaaagatgtgggcctcgactctgtgataaaccgaggtcggctgccatgatgaggacatggtttcacatgagtgccttgtttttaatgcccgtggagagagagcaggcgcacagcatctgactgagtgaagggccacctctctgaaatcacccctgactttgatcaggaggcagagccaggggtggaacaaatatatttgatctgaagagttaaattctccctcagccagctttttaggaat

SEQ ID NO: 2095 - DNA, 371 bp, Homo sapiens
caaaaataatcaggcacactttttattttacatcttaatcaacattacaaatacaaaaggaaaaaagtcagaaacaactcatcacagaggaaaaaaacatcattcagaagagattaatctgaacttcaacattctttgtgctcattttaaaattattaaaacaggaattcaaaaggacaagcaaataaaaaccaagtattttattaattaaaattgagaccctaaaccaactaagactatacaacttaaaaataagctgtcttcatcctagaaaagtttgatttgccatcttataatgaatatgcaggaacttactaatgggtaagtaaacaaattttcttttacaaacaagttattttgagttataggga

SEQ ID NO: 2096 - DNA, 426 bp, Homo sapiens
cctatctctttcacaagccataggggaacataatcctctttggcataaaataatgcacctttgcaaatgttctggatttctgaaatagctaatacacctaaatctatagcacgtaagcaatttaagtctcagcttgaatacgctcttagactattataaattaaaactgcaattgtaaaaggaaaattagagaaactaagtatttagagtattgtttatatactagcacacattattacagcttttgctcttttactgttctcgttctaattctgacattcttaatacctacattcctcgttgtcatgtattcccattttacttagcaacagatttattacgatacagacttctacatttacatacggtatatttaaatctaattatttaaaccttaaaatcatcagtatgcaactaaaatagtga

SEQ ID NO: 2097 - DNA, 504 bp, Homo sapiens
cattttcgatatgtggtaaattttgtctccaagaaaaggtttggagactgaatttttctcttttcctaaaggaaattcatagatagaatgctgaatatcatccacatttaaagatttgacaacataaaagttagataactcttaatgatgtgaatctttaacttatgattttgagtaaaggattatctagaatcaaatatacacttattaatcttcatttcccaaaattggtccatatttagacaactacctggcacaatttcactagataaacctaaaatctgaacaatggaagttaaacttctacccaaagtaaaaacaaagccataagattccacaattgaattggccacaaacattcacactatgttataaaggactttctcatttcaaatacatcactgaatgttcaacagaatttgcaaacataagatccagaatgactagcaaaacatgctaagagcatgtcaaaaagtaaaacaccacctctccccccccaatctg

SEQ ID NO: 2098 - DNA, 430 bp, Homo sapiens
agaggagtcggcgtttgaagaggtggaactcctagggcttttttgagagtgctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattgga

SEQ ID NO: 2099 - DNA, 421 bp, Homo sapiens
gcttttgtcacatttattcaaactagcacctccacagtcaaagtgttgtcatcctacagcctcaaggcccctcactctcaatgtatggaatgtcatggtacttgatgttattgcatgcccattgctgcaaggcatcacacaagatatcctgagacaggcggtgtgcatattccaagatcacagtattggtccctggaggttccttcacttcctctttgacattaactggagaagccatcctaggtagacatctctcttctggcataaagggttcttcactctcatgctgcttctcaccttcatatatggtaggaaatgggaaagtttgctttgatttcatgcagcccatgttatgaagagctgtttgtggaggaagcagtggcaaagactacttccaggccatctttagaaaacaatgaaa

SEQ ID NO: 2100 - DNA, 415 bp, Homo sapiens
ataaatccaatttcttttattttctgatacaataaaccaaaacatcaaattctaacatcactctcttaagtatctcctcctcagaattgtccatgaaccccaaagatttaccaggtccaagggtgaaagtgggacttgagttctcagtgcaaaagaaaaccctcaatgcaccactgcaattgcttcttgtcacatggtggcgctgttgaagcttagtcctgcacagccctggcaataaaggaactgcctaggccaccaaggatcttcaggggtcttcaagccctttccgaagtaatgcttgccaccaaaagcattctatattagagcttcaaagttgcagctcttaaagatatgctctttcatctcacatagaggggaaccttccagaacaccaactagcctaggagcagttcta

SEQ ID NO: 2101 - DNA, 409 bp, Homo sapiens
tgaattcctaaaacatagaaagctgttaaatacttttgggcaatgacatacacttttgatgcctcaaactctgaaactgtaaacaaaccagattccaccccacttccaacaaaccatgtcccagttgatttccctctttctatctgatgtgctccttcaagattcaagcctcttgctgggggaggggaggagagtggtgacagcggggggggggtggtgggggcgaaggggagagattggtcaatgggtctgaagctacagatggaaaggaggagtaaactctggtgttctattgcacagtagggtgattgtggttaacaatattgcattatgtatttcaaaatactagaagattttgaatgttctcatcacaaagaaattatgtttttgaagtgatacataagctaat

SEQ ID NO: 2102 - DNA, 412 bp, Homo sapiens
cagagttcagaggcttgcatttatttaacttaggaaaggaatcgagcaaaacagacacgaacacgattctgtctgaaaccatcactaaccggctatagattctgactcactcaaggaatattgtggatattttaagaaaattttcctggttttctgctttaccaaagtgtaagatatggctggggtgcccctctcagcagatgcagaataaattaatcccaaagcaaagcggagcgcagggcagcctcgcgccacctaacctgtgtctcagcttccagcttccaccctgaagtgcgtgtggtcgtggagccgcgttgcgctaaccaggaaagctggaggcagaacgaggttggcccacgacacgtacagacatatgaccgacataacagtaaacgcacacgtgtctcgcacg

SEQ ID NO: 2103 - DNA, 356 bp, Homo sapiens
aaagtgtagcaaccctttaatggatgttcaatacaataccgttcatatcacttatacaaactttctcagtacaattttgttcacgatcatgataatgctgaatgacagagtgaggaagtgggattaacaaaaaagtaaaagcttccagaccagccagagctaaagtcaaattaaggctctgctcttgccagccactccaaccttaaagaagttatgttattatcatggataaatttttacacaagattgtaaaaattaaacgttaaggataaaagcccacaacacgtgactgatattcctcaaatattaatttcactatttgtgacccctaaataaatgcatcttccaggtgttct

SEQ ID NO: 2104 - DNA, 396 bp, Homo sapiens
cacaattttttttactaaaagaatagatttttattaagcgttgtaagtttctttccatcagcattaacagaacaacagaccaatttccatcacagaacaactcctgaggcattctcattcctttctgaaactcttccattaactcctgaagtttccccaaagaagcatccattcaaacttacattaataaactatggagcttttgtggtgaggtgggccaaaaaggcagggaatttggaatctgggagtgggaaagagaaatacatattatccatccactaaacacactgtcaaaagcacaggagaggagatagtaatacaggaaaaaaacaatgaaataattttttacttttgtcaataacatcatttatcagggagcactaaaagtcactgact

SEQ ID NO: 2105 - DNA, 350 bp, Homo sapiens
cagcaccacaatgtttaattgattcccgttccagctttctcaaggcacgacaggccccctcttcctcatcttgatttggatacaagacgccagctggcaggcaggaggtgctgctgaagccctgcacggcccctgaaaactgtcacggctcaggagctccaggctgaggcctgggggacctcgcatcagtccctccacccaccctgcccatgggtttcaccacaggcagctccatgagagccccggcccctgccctggcggcttctgctttgcgggaagggccctccgtgggctctggctgtgtccctgtgctcttccggcagtgtcagggggtagtggcctcggcctgg

SEQ ID NO: 2106 - DNA, 399 bp, Homo sapiens
agcttttagttgtgagtgttctttattttcttaatttagatttaatttcttaagtatagaatgcttttcttggaaactgttcttgaagaggatgatttcctaagtatagaatgcttttcttggaaaccgttcatgaaggggatgatttgcaacttctgggactccaccagtttgataaagcaagtcctttcacatttgccatctgggctttggtttccctatcttcaaagtcacaggtatactatttattctgacactctatggtggcgataagttaatgttgggatgtttatcaagttggagaaaagctgacatctaagcaaggttttctgatacacctctttcactgattcttttgcaggtgacacctattgaaatatttgtttacccttatcaaag

SEQ ID NO: 2107 - DNA, 439 bp, Homo sapiens
aaaaacgtttaacttttatttgatgcttctgaacataataaaataaatgaacctaaaacagcgctttaggcagcttggaagggaagatacattccatttaggttaaaatacatgggaacgatatgtacatttgggcagatattctgaactctactgggttaatggttatgcctgtacttgagcacatcagtgagaagtttcccatcacattttatctgaaatgaacaagatgtcagggcaatctgctagcaaaacctgcgctcggggtcagcgatgcttctccctctggaacactcatcatgcccgtccctaggacacgttgcctctcttcttttgcaaagctttcatgaggtctgacatgaaatcttgctccccgcctcctgctccgccggggtgccctgggttctcttgcctcttggggggcacaggaggcctcttg

SEQ ID NO: 2108 - DNA, 442 bp, Homo sapiens
catgaataattttatttttattttggtcatgactttttaaaattaatggaaagtctcagtctgctcaaatgataaaccaaaaaatggggtcatgaagcaaattcagtctttgcatttcttcaacaaccaactcacatttctctgctccttgactcagaggctggacatgtgctaacagcttttttgcttctgtatatccttaataggatggcagaatcccggtgttaaaagaatcttaaagtcagccgtgtcaccatgggacctcgattagcaaacagatgtagacattccttccaaattcagtcaaagaaaaaactctaataccagcagccatgttcagggtgtgcacgacatgctgagcgcttgggatacatccccttgtttaattctcacagaaactttgtgagacaagtactataatccctgtttaacagatgggcaa

SEQ ID NO: 2109 - DNA, 417 bp, Homo sapiens
aataaggcattgattttaattactggccatccatccagccccagagcaacctccactctgtttggttttgatgaacaaaatagaagcaacaatcaagacatcaggaaattacatgaaaaaacatttaaatcttaaaatctttcacaggacaacagtattgatattggactcaaaactgacaagaaggaagaaaacttccgtgtgctcatatttttgagatgaccacgttgagaacagatgactgactccgagttccattttctttaagatattttgagcctggccgctctccatgcgtggcttccttctctccagctggtgtccctggaggctgcagccagagccacaggcccatcctggctactgcactggtgttcggtggccgcttttttttttcctctctgcagaacacaaatc

SEQ ID NO: 2110 - DNA, 438 bp, Homo sapiens
gtcatattaagaaaagataaaacaaactttactcatttctgcttctgggcatggagtgtgagggaccagacttaagttctcaaacaactacaaaatcagaccaaaaaatacaatggtttccaggcaccggacgacaggcagtgcagggctgtgatccttaagagaagggaagcagcgagccagagtatccaggccacaacccaaatggaggccaagagaggaacagcagaggatacagagggagggttccaggggccaagacgcaatccgaggggaagcccttccggggagagctggagtcctggggtggccttctcgagtcttcccgagcaggtctgtgcagcgaggaaacatccgaggctggagtgagccacgcggaggaggaagaacagcccgagctcacaggggcggggaagagttctagctcgcgacacccct

SEQ ID NO: 2111 - DNA, 468 bp, Homo sapiens
aaaggctttctgtccaaagatgaacttttatcgattctttcaattattgccacaattgaaaaggtgtatgtccaatcatttttcatggttctgtttttgcttactgtcataggatttcatcccatctcatttgagttgcaatttcaaaaagcaaagccttgctcttttctgactgaattcaacatgcataaagaattttatggcttggatcctatggctcaaaaaggtttgaaaacatagcaagcagcatctatttaaaaaaatcctagggttgcaaaatattacaaattgactttgcacactcagactgaagacattataaaagacaaacaaaaaaggtgatacaactcaactgcaactgcatgatcatctattataccagtatgcactgaaatatatttttataaagctctgcagatattaaaccctttcaccagctaaagtcatggaaatgctctctttaaggca

SEQ ID NO: 2112 - DNA, 433 bp, Homo sapiens
aggaatgaaaggtcataagccattagaaatagtggcattattatgcaataacaacaccctagctaacctgcttttgtcatctgtagcacttacaataaagaatgatgaccttccaaccctggacactacctcgataaagcaaaccagagatcctctctacactttctatggaagccataaaagttgccatcaatatatccactttcatagttctatacttttatactttctagacttttttatagactttatgatcagatctttttgtctcagaggataggttttgcaagattcaaaggaaaatcaaactccttggttgttccagctttgaagcttttgcttcagtaaatttgtttaaagaaccagatcacataccatttatcaaattctttacttaagtcagaatactttgcagacatacatatttggaaaa

SEQ ID NO: 2113 - DNA, 428 bp, Homo sapiens
ctactcaaagtgtctttaatgattcccaccactggcattacatcctgtacgcttttaggtggatttccggtgaggtgatgcacctctgaaacccttgctaagtagagtatgttccagttcaaccagcttgttttccaccatactgaggtttaccaatattcgcttctgcctggctattgagtgtgggaaattatttaaaatatcccgagagaggtcgtagactgcaagattgttgtctgtattgctgttaattaacccagaagaagagggtctcactagtgcaagagcagttgaatttgatgacatttcgccagtgtttctctgaaagcggcgatatttccagaagacaatcaaggcacacagaatgctgctcgctaggagtaaatagaagttcatgtttcctcttcggcctcttctcccttctcggg

SEQ ID NO: 2114 - DNA, 421 bp, Homo sapiens
gtgagtgtatcattttatttccttattctatttcaacaatagagtatatggctccatatgaatagcttcagctgtcatccatttccccaacaattatgccctttgtctccaggtctcattctctctccacttctgggccttcaagtcctgaggatcagtttctgatgtgggacagggatacagccacccctcccaggcagagcatgtcctgcaggggtggctggcctgaggaggtgctagggggaaggccctccaaggaggcctgcagggtctgggccatgctgtggtcagccaggtgtcccatgctctggagctgctggaagaagccatgcagggcctggagtgtggtgttcgagagggtagacaggtcagccaaagccacaccttgcagaacatcacccacctcttcatgagagaggac

SEQ ID NO: 2115 - DNA, 393 bp, Homo sapiens
cggtgaattaaaatgtatttggtgccagtggtgctgaacatagaataaaaaacagaaaaagggcccagacagggacatccaggctggaggttggagtggagcacagtcagatgtattcacttttctagcatgggtttcaaagtgcgtaaggggagaaaacgcatcatggattgtgctgtgcatcctggacaccgtgcgaggtgctcatagctgtgatcttgtctcccacaactctcttgggtgacagacgtccactgtccacattttatagacaaggagaaagggaagtcaaatgtctcgtccaagtctacacagctaaaaaggggcagaactagggtgacgctcaggcctcatttagagatcgggggttggcgagaagtggggtgggcttct

SEQ ID NO: 2116 - DNA, 397 bp, Homo sapiens
gaaaaattcacatatttactgtgcattattaacaataacttacttattgaaaaaaatttaaggtaaactattcaacttttatttacatctgtaaaaacttgatctaggtttcttaaataagaaagtggcttgaattttaaagaggaatcaggtaaatctattttctcttcctctctcacgtttttcacactctgccttcaccatcacacccctgttgactgtgaatattacacaaaagtacttattcctgttttttacaatgttcaattaaagaaattggttgacaattctggcctttggaaaaagacaaggaacgtaggtaaacaaaggcgtaattaaagagatatcttaattttagccaatcattgatgaaccactctccttgctcatgaggcgg

SEQ ID NO: 2117 - DNA, 415 bp, Homo sapiens
gggagtgatgtattcttttattgaagcaagtatgtccagtcacaccaaaactgacgtcctgcattatggtacagcttcatactcagagttcatctcaaataccaaaacatcaaatcagggtatgtatcaaattgggaaaataaagtagcagacagacactgtttcaagtaggtactagaactgatcacccgtgaagtgcacgtggatgtgtacagaaaccgttctaaggctgtattccaaatatatattctcaagttttaagcctttctcatctcaaagacataaacaaagcaatatgtactatcaatatacaatctgtactagctagaacctcagaaagtgcaaacacactgtgacaatacagtggaactattcctgctccacccaggaccagaggcatgggcagcgggcccag

SEQ ID NO: 2118 - DNA, 410 bp, Homo sapiens
cattgaaatcattgaaaattcaccctgttcccatctgtgtgacaatgagcatgcttttaggtccatagatgatgcaaataatgaataaaacctaatgcaaaaaaaaagggggggatagagtgaacatctaacacctgtccgggttgaataattctgtctacccaccctcaaacattcattttaccgtgcttttttccatgaggtcatgtatacaaatgattcaatcatttatttacttaacgaggcactgaatggatgactatacgtagttctcaggcaaatgtgatgagaaccgtatcttctgtttcttaaccactctcttccttgggtttcttttctacgaaatggggaagaggtcactgtgacttcagttttacgagaaactgagtgcagagataagaaaggttcaa

SEQ ID NO: 2119 - DNA, 370 bp, Homo sapiens
ccgaaaatactttaatgcgaggtcctcgtgtgggtcgtgttttggagagataactggccttggactggagggtggctgccttcttcctttgccaggtcatgcgaggggctgctggccaccccatgcacatgcccctgcccctccatgtcagatgcgtgcccctcggggctggccgtgtccgatgcaggccccttccggctgttgatcttgatggcggcgcgcagcgccgacttgaccgccgtctccacccagccgtgcgggtaggcggtgtgctcgccggcaaagtagatgcggccataagggaccgtccagtcatccttttcggtttgccagagcgccggcggctgtaccacaaagccaccctggctgt

SEQ ID NO: 2120 - DNA, 391 bp, Homo sapiens
gcaatttataaatacggtttattaccatggttacaaactttcagaacaggcctctgagacattggactgagactctgccgaacatcttttggcatcggtgtcctttttcttctgtcgcggaaggcagccccggactgcaaggcctccagcagattatccatcactcctgtctcatcaccctcagtcttcatttctaataaacgctttttcttttgttggcgttcgagtctttctcgctctgctaattctttagctattctgacacgtttttctttttcctctgcttctctttttttgatattctcctttattgcttgcatgaatgtggttctgaagttattcaggtcagtaagaaagtcttccacagacaccttcttcacatcaatggcat

SEQ ID NO: 2121 - DNA, 422 bp, Homo sapiens
ggaaagatgaaaaatttattagaaaagatctttaaatggcttttactaaagcgtcatttaacaatttttcatattatagaaacagcttttcatggatggtgtgactgggtctgtatccaaacccggttcggttcctggagccaacgctaatgttaacactcagcctcttgcagttaacactcagcctcttaactgggagtggccctggagcaagtcgctggaatgttcaagctccgcgtcactcatcggtaccaagttgatgatctctgcctagggttcttcgccaccctcaggctcaagtcccaggaggcctcctccgctgacttgggtgaacagctctgagttccggagagggttcggtctgcggagaagcgcgcgagagacaagcatcctcaaggttctggtacaaaatttggaaaatg

SEQ ID NO: 2122 - DNA, 372 bp, Homo sapiens
atggatatctttctgttgtaatgctttttttttttgaaatgtccatttctaagacttttccagatacttcatccaccatggactgttttccataaattttcttatgaccttcctttagtttccattcaaattcacctatgtcagaccgaaaacggccatccttgcataaggctccttcaatagtctcacccttcaaggcataaatacaaagtttacttcctttttcatgaagttcgttgatcttaacaatcttctttcttgtccttcctatagcaacaacatgaaaaagaatgcattccatgtttggattttcacattggcgtaatatgtgtccatcttctttgctactctttctttgaccaaatgtaattt

SEQ ID NO: 2123 - DNA, 450 bp, Homo sapiens
gggttcaagatcttttattttcagagcttccatcagttggttagtaatgctagctaagctggtataatctgaaggccatcccacctttctctttaggcagtcaaccaacagaatctctttcttacaaacaatatcattaaccagttggaatctgtctcaatgcgcgtgtaggaagaagtcctctcccccacatttttcccaacaagattgttttatagccaaatgtaactcaaacccgtaacacagcaactagccatctccagtatcactgattcccaccccaagaagttgaggtaagaggggagagactgtctcctgtttaagaaaaacccacctacacctcagtgaagccgtgatggtaaggaggctggcaccagagggcagggatgagtaggcactgaaacaggtctctctagaatcaatgaagtctgccccagctccttggatgag

SEQ ID NO: 2124 - DNA, 427 bp, Homo sapiens
ctgtgtttagcatgtcttataaaagaataagatggcatttgttcagttaattttgtttttgaaatggtgttttagatgggtgaatatgaaaataagcttacctcatcccactctaaaaggtagttggtgatttttgaaccgttgtcaattggtgcctaaaaaaaatagtaacatgagattagagaaagttgttcacagacaaaacttatgagttacccacctggctcacatacagtgtctatgatagtcctgtgctctcccctcagggggataaagctgatggttcctgcgttccttggtcaatcatcatcatacactaactttgacatacctcaacagtagagagagtccccactatgaataaatcatactccacaaatagccaaacctacctaccaccaccaccacctctccctttttacaccct

SEQ ID NO: 2125 - DNA, 377 bp, Homo sapiens
aaggcaacacgttttacccacagaacaccatttggaaaagaacacataaccccattttcaccacaaccctaggtggtacatacacaggagagtgacacattttacaaatgaagaaattaataattaaaccaattcccttacagagcattgtcttgccattaacaaaccactaaaacttacattttactatctttataccaattttttagcatctttattgagatatacttcacgtcataaaattcacccatttaagtacagcatatgtctaatctataaagatgctacccaaagtttagttctcaatcttacaaaatcttacaagatcatctgaaagcagatcagaaatgcaaattctcaggctgtacccaagacct

SEQ ID NO: 2126 - DNA, 372 bp, Homo sapiens
gaaaaaagccttatagtatcacctaccacttaaaaactttgtttcctgctgtctataggatgaggtcaacattcatagcacagcacttaagctccaccatgcctctcatttcatctctcccaacatatacagagtcccatgctctagctccagttgatcctttccaacattgccatgctcttttacgtttgcacatgaagttccctttgtctagaatctctgattcctgaacaaatttacctggcaaattccttctcatcttttgtgaccaagctcaaatgacagctcctcagtaaagctttcctcaatccttttagcagagatagtagatacacaagtactaggcaacttctattacaatgctaattactt

SEQ ID NO: 2127 - DNA, 382 bp, Homo sapiens
caaattgacacattttattaaatataatgtgcaaaatataatgaagtaacttctatttaaaaaatggtacaaggcaggtattatttaaaatgctttagtaactcattttccataaaaagaaatctggcattataaaaatacataaaataatcatgatttatatcattaatttacgtaagatacttttttgcataaaacaaagttaaaaaatagtttaaaaaggtattcttatatgagcatcattcccagtataaaaattttcataactttttgtaattttggttcatctgtataaataaagcatttttatccttttaaaattcataactccatttaaaaaacataagattctctctcttttaaataaaagttcacttgaggt

SEQ ID NO: 2128 - DNA, 347 bp, Homo sapiens
gctgcaaagagcacctttattcacagcaaaaggacgtcaccatagcaacaacacttcaattccctgagaacttttcccttatcattcgctttcctagctatgtctttgcaaagagaaaaacaacaagaaacacagcccacgggacaggtgagccatgctgggcccagcggggaggtggcagctacacaggaggagggcagggatgggaggttccagatgctggaacgcataaatacacagagtgccagacagtcccacttcagctttaaaaacaaagatgaccccgagtttggcttctgttttttctgatccacagaaaagataagataaaataagaccctccccca

SEQ ID NO: 2129 - DNA, 393 bp, Homo sapiens
attaaactgaacatttttattccaattattcaagtttttgctgcacagtattttcaaatgttttattttcaaaatgactattacaaaaaatgtagtttccagaatgtcatggctacacctcaacctactccactcttgcagtgggggcaacagctttaggagcagggaccgtgtgtgggggctgcacccttgcagtgcgtggcctggacacggcccaagccctccgccgcccacagacaacactttcacattgataaatatgcatgcccatcaaatcctgctgtaaaccaaaactaaaattctaagtcccccagccaactgagtgcatccccttgcagccaccgggacccaaagaaacctgaaaaaccagttcaggccatgaatgggaaggag

SEQ ID NO: 2130 - DNA, 493 bp, Homo sapiens
aagctaaaatgttattgaaaacaaatgtttctcaacgagctgcttcggaacaatataacgtattatgaagctccgtacattttacatgttcttgcaatcttgacaggacaaaataagtcctcaactttttcctttgaattttgaaactgaaaccattttcttccttttccagactctcctgcatcaagaccgggctgtttggaagaaaccgtgtaaaaagtgcatgagcagtgagcatggaagacatggaaatgggatgcgtctggggctgaaggtagcattgactcagcgaaggctctcactctgcttccgtggtccccgctggggcagccagtgtcaggccaggccaaactgacacagcagaatgaagggctgtacagtgggtccccatgaaacatgttactaaaaaaaggtgcaacgagaaccaagtccctgtgcattcttagtcacaacggtgggcagaagaacccatacgattcctccctttggtatt

SEQ ID NO: 2131 - DNA, 376 bp, Homo sapiens
ccattttcatatcctattttatttttgaagtcagtgtccagaaagaaaccgacgattcactcaatcaacatgtaagcgactgaggcatccctacacaccaggtttgcaggctagggaccagagacacgatggttaaacaagccagagccctgtgatcctagggcttacaatgctggcataagaaaatccttctggactcactgtccccatgcttgtgactgtcatgtgccaagtgcgctttacacaatctcatttttccctcaacttggggataggttttgtatcattcccattacagatacggatgctgaggttactgagtggaagaggaaacctgaattctgctgctggaccccaaaactcatgttaattaccc

SEQ ID NO: 2132 - DNA, 355 bp, Homo sapiens
gattttccaaagaaaacaaaaaccactctttacttagaactcttgcttagacacaagagaataagatgactttaacatctgagatatacatcaaagtggccttttgacagtttctttcaatttttcggtgtcacttcctttaccaggttcaagtcagaagcagaaaaatttgaggactgatgggcccaggagttgagttatccagagtggaagatgtattcatctcccaggctgagtaaggtttacatatccaaatgaggagaaacaggtttgcttcttctcttattgtctaaaggtgtctgaggactttggcaagatgtcatggaatccttcagattttgtttgtgcagaggat

SEQ ID NO: 2133 - DNA, 373 bp, Homo sapiens
gcacaaagttaatgaaataattattttttggtcataccttgcacggaaaatctgccaatagcatttgacatttagacccactaggcatcttaagtagcctgctactcacaagacctaccttttcccactgccctattttacaaacactcttagctctgtctcctgctctcctctcctccaggaagctggagaacaatccacgaacagtagtgactaagatggcccctaatgaccatatgcttgtattatggccttcccttgagtatgggcaggatccatgaatgggatggaatacattcctttgattaagttatgctgtgtggcaaaagagattttgcaggtataaagtccctaatcagttgactctgagtta

SEQ ID NO: 2134 - DNA, 382 bp, Homo sapiens
atctgaaaatgtagtttatttcatctgaaattgttttctataatttccctctccacccataaatgaccttctttttatactcatggatatactcacttatgaacctgtagactatacacttcacagaaataggagaaaccataatgttctcctggcactgagggaatatcaatggtattctaaatgaggaactattaactttttattacaataatgattttttagtaatttccatagtttgaaatgtggttaggatgctactggcagttgaaagctgacaacatgattgaatagttttaacatgatctggtgtttgttacagtgctttaaaattttaaatattatcattcatgttataatgttatccagtgatagtcaatta

SEQ ID NO: 2135 - DNA, 432 bp, Homo sapiens
actaaactaaatggtcaatactgccatctctcttgataatgacaaagtgtttgcacaggatgcctacaggtgtgtgtgtcgctcctcactaatggatccgtagtcatatagctgtgagaggcactcctgggttgaaaatgaaggcaattatcacattactgtcagtcctgactgagtcacctctagagtttatgctttcagccttaattgaaatgaagacaattatataaaattctcacataattgatcacaaatgtgatcacagccactcttgactaagattggtgccggccaatctgctgtgagggaatgaagagaggagaggaactgcgatgtcagtccctgattctactgcaagtttccaagcacatgaaatcccattctagctttggagaccccaatgtgacaagaatctccctgtgctttaaatca

SEQ ID NO: 2136 - DNA, 398 bp, Homo sapiens
ggccttcgagatcttttatttttctaaaggtgggggttgcccttctccatccccggccagtccgacttggtgctcgcgattgaatttaaacgaataatccctacttccccatccaaaattagcggataggcgcccttgcaccggaaggcctcctcaccagtcttttctttttgtctttgaaataattcttagcctcagaagtcagcattttcaagacctggcatccgcagcgtttctgacgcggggacttctctcttcggctctgaggtctccgcgcgcagaacccatggcagcttttggtcttacgcgtggctgtgagctgggctcagctgcgtggcgcatccacccctcgattgacgcgcggagaagcatttttcattttttctttcagcttgtat

SEQ ID NO: 2137 - DNA, 437 bp, Homo sapiens
ccaaggggagaatgaagccattttatttaggggaatgttaaaacaaagccatatacaatctgtaacaaatacaatacaattgtttgttccctagtcctgaataattacagtatatacaaaatctgtaaggcactggttcccccaaaagaacaaatgagtcttcttgtgaaacagacaacgaaacccctatattgccaacttttctccaaaaaatatggcattgtttttttgttttgttttacaagaggaatcacaattgctaaattaagtcacttctgatgccatttctttcatttccactgctatgtgtctgggttttctaaggcaatgtaactactgaacatgttcaagtttaaaaaactatacttctctcagtgccgttccacccacaaacaaagaagaatcagatcagaccaacaacataaaacttctaatga

SEQ ID NO: 2138 - DNA, 430 bp, Homo sapiens
caaggcaataaaaaaaatcattttaatttttgatacatattaaaacatcttagtcagttcctcctgacagcattaacacagacaaatacacaagacttcaaacatgctttaaaatgacattcagcaaagtacttaaaatttaataaatagcaaatcacacacagatacatttttcataatcattaaactactaaaacagacagttaaagaataaataaaccgcaactgacagtaaaaaaaatatgttgggttttgcaattcacactacttaaaaaggggggatgatctgaatgatttcttaattttcttttgagagtgtagcatgatcccccccaggaataaaatatattgaaaaaatcactcttacaacaatgtattttttaaatacaacaaataaatatgaaaccagcaaagcaatttcaagttgtaa

SEQ ID NO: 2139 - DNA, 503 bp, Homo sapiens
aaataataacaatttaatagacaaacaaaatagtatcacagtgaataaaatattaaagcattatctttttatcattcaatagcatgaagagttttctggtgtcatacaaagattgctctctaaagccaaattaactagaaaaaaagactgccacaatacacggagacacaagtttatcactgtagacattatacagagaagcaaaacacatcgtacccatgtccagagctttctagaaatctcattatataactcaccaatttactcaatgttacatttcaaacaaaacgaacatttttttaaaaaaaccttacaaatatataaatccaaaccacaaaacatcttctaaacatggtatttactctaaacacaaatggatttctggaaattgcatcacaatgctatctaaactagattttatgaaatcataaatgtatttagctgtatcttggggcttaaattcattggaccatatcccatgtatactattctcatcctactta

SEQ ID NO: 2140 - DNA, 444 bp, Homo sapiens
cagtttatgccaggttcagagtagaatgtgggtaggtgggctaacaccttgctcaggggtcatttatccagatggatgcctaatatgcccttctcaatgaaggaggtgactggagagggtaggaaaaagctaaggataatggtttcctctacatttcataatttaaaatagtactatattaataaaatagttcagagagaagaaaccactcaaccatgagttttcttagttgtatcttcattattcctgtcccataaaatcctagcttaggataagttatccattaggttttgtggtagcattctatcaccatttgcaaaacctaacttcctacatacagatgtttatgtttcttgaactgagatatctgaatgcatgccatcttgactacataatcacaagtaggtcaacccaaataaagatcatctccatttaaatcttaca

SEQ ID NO: 2141 - DNA, 417 bp, Homo sapiens
ccaacagacatctcattttaatagtcctcatcttataaaagtgagattacagattaacatgttaaccaaagaaattactaaggtgttttgttaggataacatcacacagaatttggtctgaacaatgcaaaaggcaaatacgatgtataaaaacatatacaaaccgagcatttgttataggtactttagaattaatttctatcctcttcccgaggataacatcacacagaatttggtctaaacaatgtaaaaggcaaatacgatgtaaaaaacatacacagagtatttgttataggtactttagaattcatttctatcccctccccaataaacttgtccaattactttgttctaaattaatccttgggaacgagatcttgatagtagcttcagttcatccaacctaggacacttagc

SEQ ID NO: 2142 - DNA, 446 bp, Homo sapiens
taaattatttaatttggaagaccaagtgcagaatcttcctcttcttataaggccaccaatcctatccagttaggaacccatcctaatgacctcatttaaccttaattacctcttataagtcctgtctaggaatagagtcatattggggtttatggcttcaatatatgaatttggggggatggggagacaattcagtccatagtaaacactttctcaaagagtagttataatgtttataagagacaatgtaggtaaaagtagtttcagttgcatgcagctaaatgcagtttagtatcccttcagagtcctccgcagaaaaggcacctgataaatatttatgtggccttaacctaaggtattattctttatatagtgccttcccatgtaatgattgatgtcatgtttatcattttgcagtgcagtttatttcttatagggtcatggct

SEQ ID NO: 2143 - DNA, 417 bp, Homo sapiens
aacttttattaatctttattttaaaacataaccagatgcaccttggttgtttacattctctggttgccattcagtctcaaagtaaacactgggagcatatgataaatcgtagtttaaggaagccatagcacttacagagttctcaaatggttacaatataaaatctgtcataaaaatcagtaaaagatgcaaggtagaacacattttaacactggtacaatggcagtagcagctttgcaaatgtttgtctatatgatttccacaggactttttttttttttgcctggcctcattatgtagcaaagcattttttcttttctttttgagatggagtcttgctctgttacccagcaggctggagtgcagtggtataaacacagctcactgcagcctcaacctcccgggctcaagtgattc

SEQ ID NO: 2144 - DNA, 440 bp, Homo sapiens
ccacttatatgattattttcttcatcagcaaagggttaagagcagtttacaccaaaccaagttaccaagcagatcacaatcagttcacaggttggataagtcacggcacgcaggccagaaaatgtactcagacttcagtcaacctaatgggacagtgtactcacactgtggttttgttgttttggagtctagaagctccatctacccattctccatggtctaccaccatgttaacacagatttaccacaggcgccatctgtaccaagcctaggatagactctttaaaaaaaaaaaagacctggccggtcacagtggttcatgcctgtaagcattttgagaggacaaggtgggtggatcatgaggtcaggagttcaagaccagcctggccaaggtggtgaaaccctgcctctactaaaactgcaaaaattagccaggcacg

SEQ ID NO: 2145 - DNA, 428 bp, Homo sapiens
gcaataaatgctttttattgtatgctcatttcaatgagtaacatttagaaataataatcccacataacagtagcgatcttattttacagcgtgtacatcatttacagccacataacacacaattttagtagatattccaaatttaatattctgaagttaagaaagataaaaaatttattctcaaggaactgattcttatctggtgcaaaaacagaaaggtgaacattatttgaaacacaaagccacaatatagcatgaagtaaaattacattttaattatgttgaacagctgaatgtaaacatgaagcaactaaaacttaaaagtacatatcatatgcattacatttatgaacaggattttcataaaatttccctaaaccagcttttaatattaagtgccattttgatttgcagcatgctaacacaaa

SEQ ID NO: 2146 - DNA, 356 bp, Homo sapiens
gaagttcataaaatcttttccgagccagcgggttgcagccagagctgccaagttcaaaggcattgcgtgggttcaagtgccccccaaggctgttgctcagtcacagcttccagagcttccttcccaccacactgccaggagctgccagagcccccatgcagcccctgaccccagttccctcccaagtcccagggcctgaccctgatatctggggcaaggtgctcgggacatagataagtgaaatggtgtgcagaggcccagtggagagtcacatctcggtctcagccaacagactgtcccctagtcctgacgtcattagcaccatctgagagctgggatcgttggggcacatccag

SEQ ID NO: 2147 - DNA, 415 bp, Homo sapiens
acaggatatatatttattaacagtgaaaaagcatttacccaaagtcaatgttacaaaatacaaagagtacctccacagtctggccagctcattattttaggcattatctcaacctgcataaagttctctctcactcattttgaacttttctccctctatctatctgtaaccaaaatttttaacttcaaaattaggacaaataggaatactgaatgcctaacccttcagcaatagttactagagaaaacagattaaataaatatatctgctctcaaaccctacgtattttaaaactaaattatctactaaaatagaaaaacaatagacttagattaatagcagctgtaacaccagtcaaataagcaattttgataaggttcataggtactatggtaataactaagatataaataca

SEQ ID NO: 2148 - DNA, 420 bp, Homo sapiens
caatttgtgaatctatgattttttgaaagtaaaaatattttttaaagttctaataaggaatcaggaggtaagacctccataaaaagctttattattgaatgatacctgatctcacaaaaaacaaacaactaagcagaaaatattcttgaactaacccagaccctttcttcccatttgatgacctagtattgctggtaactcaacataaaattacatccctagggaaaaaaaataaagtcactctaaagagaaattgaaaatgagaaaaaggagagtaaactttaacacaatatgctaatatgaattaaattattagatatttaaaaaatctgaaatagcaacttaaaaactcagaactggacaaacaaaatgcagatgtgaatgactggctaaaatcaggaaaaaaattcggagaaaaag

SEQ ID NO: 2149 - DNA, 382 bp, Homo sapiens
gctaaaaatttaccaaaatagtttgaacacataaaaatatttttaaaaaaacaaaaccaaaaacccagcataaatttagttgtataggcattggttagaggacactgttttcactaaggattatattcaacaactttctcttgagttgttactaaaattctgattctgaaccttatagcttataatggtgccaactattagaaatgggaaaatctaattcagtccaatgtaacatgtattatgatataatagatgaagggtatgtctacactataataaaaaataaacatatttttggttatttaaagaccatcttcctaacctgtaactaaaataactgtatttgatttaaacttatttaagtgcagtgaattatggaaag

SEQ ID NO: 2150 - DNA, 507 bp, Homo sapiens
aagtttaaaaattaagaacaaatactttgatagatttcttttataactccttaatccatctagtagtttgcaagtcatgaactgacaatcttcgttcacctcaagtaattagatcttgtggtaccatttatatttcctttttataactatagataacaaattatataaagatgtgaacattcttcccttatcacctccccctctcccaccccaatcctaggagtatcctgagtgagcatgtatgccttcaaatcttttcatgtacattcacataaaatgtaactttaaagactcaatgtgtatattatacacataggtatgtgaatatatagcatgcatttatttaatttgttttgacaaaggtgagatccatactgctctgcaccttgctttgctcacttttcataggcatctttccatgtcagtacatacctacctcttctttttaatattcataacacattctataatgttatgtactataaccagtctctgaacatttaggtt

SEQ ID NO: 2151 - DNA, 511 bp, Homo sapiens
ggtcatacaaaacgtagttgtgaaaggaaaagaaaatgccagccctgtttgacagacattagatttatgatcgttttttaagcctcaagtacgtcacaagaatcggcccacccactgcactgccctgattgtaaacacggccaagtgcccatccctgctcttcccctatcggacctgggctcctccgcttctgaacagcccttgtttccctctcctggtctctggtgggttaaaaagatgcctggctgtatatatatggagagcgtacaccatggagctctctgagctaaaacctccaagacaaacatagcccgctcacgccttccccgtctgccggcaggccgcagatgttaataaacatggttggggtttagggtttgcccactgattcctccatccattttacactcgacaagtcaggagagcattttttcccccttcccttaacgtacaaactcagtaaactgttgtaaggcttggcaacaaacttatgaattttggcctccagatg

SEQ ID NO: 2152 - DNA, 499 bp, Homo sapiens
gcttttaaattgttttattacaattaaaattacacaaaagcaaatcgattcatttcaatcaaaataactcatgtttacatatttataactgtacaataaaatatataaaatgttttcatatttcatacttcaatcatcatcttcttcctcttcatcgctgatcacatacttcttatgctttttatttgctttatcatcatcttctgcttttctctttccggaaggttcaccttcctcatcactggtaagtttctttgctttgagtaatctttgagctttatcttcttctgatccctcatcactgtctgatgaatagattctggctcgttcctctcgaatgccccctttatatcggtttttaatggcagccaagctgatggactcctcgccttcctcctcctcatcgtatcgatcaggttccaggtaactggcgctcagccccgctggtgctgtttctctctcattcggcgctgctgagattcctacgtatggaagccct

SEQ ID NO: 2153 - DNA, 505 bp, Homo sapiens
cccaatagaaaaattcatttcacagtcagaattccataagccttcatttcaagtgctgaaaagagaagttgacaagtttgaaaatgcccttcattaaaaaatacaatatcccagggtatacagagactcaatcaagttggaaaactattatctgtcataaaacagagttccacaggaagtcattctggttgaccaaattgaatgattaaattctcaacaaaatccatttaattggtgtgtgtgttgtgtcaggttttgtggagctgctttaagccgaggtgctccacgtggctgacactaaatcaatgactgatttagaacacactgttcagaaaatgatttagcaacacatgatttaacagtaaaaccaatcccctcttcagttgtgttttatgaataatagcctagttgcgggccccttggagagagaattgatcgaagatctattatgcaaacttgcccttttgtcaggactgtacttgccctcagattaaagcttattatc

SEQ ID NO: 2154 - DNA, 428 bp, Homo sapiens
agaatcaggtggctcactgagctctgtattttgtttcctggagctttcactggtttcttcccctgagataccccaagtgacatgaaaagcatactcagggcctagagacactttactggggatgggcttctgtcacaggtcagaggtctgagaagaggggcaggcccactcctctccactagtagagaaaggttgacagagaatcatttcttgcttctcttggccgtagttttggttgtgctgggggcctcagccacagaggccttgggggctgtggctgctcgtgcccccttccttccccagaaagagctttggtggcccctgggaatcagactgcatggtttcttggtgggagaggaggcctggggtgaggagacggcctcagggactgtctcctccccttgcgcaggagtggcagaagggctgct

SEQ ID NO: 2155 - DNA, 376 bp, Homo sapiens
caatttgtatttttctcaatataatgttgcaagatgtcattatattctcattacccataacttcccatccaaatcttaatggcacatttggtattttttcaaatggctttgagatataattcacataccacacaattcatgtatctaaagtatacagttctgtagttctgtggttgttggttacatccaccagactgagggctccctgagggttggtgcctcagctttcccttcacttactcattcaccaaacattcagcgcctactgagtactggggttatgatggccaacaggagagacagtctctgcctactgtttggtgggggtggagtacttagtaaccgtcgtcattattgagtgcttacctgtgctggg

SEQ ID NO: 2156 - DNA, 517 bp, Homo sapiens
ttaattagagtttgtagtatacacttaactttctgtaatctgcagtgatgaatctctatgtaaacattcagaaaaagagcgaatactgtgtcatgacttatgaactataaattttgtccctgattactagtcaagaacagttttatacatttattaacaactactttcctccacttaacaacagctcttaaataacaaaataaattatcagcatttccaaccacaaatttaagaattaaagtttaaaaaactggttagtttcataaatgcaagcagagtaataaatttcatatatgttaattgcagttacttatgttctttgagtgaagtaacacaaagatttttcccttccccttttggcaagttcacaaaattcatgaaaagtcttcacctttttcttttttgcttaatttcttttttgcatctcagctgaacacaacagacaatagctggggttattagcgagacatgataaaagaaaaggttatgaccactcagacgatcatgtatacctaaa

SEQ ID NO: 2157 - DNA, 551 bp, Homo sapiens
aagataaaaccatttaaaaacatctttttaaaatataacagaaagagatcacgaagtttctagtgagcaagtcatgataagtaaaaatcaactgtacaatgcccatgatttctaatttaagacagataaatagcaatgatcgttcttagcgtgtcctcttgaatttttagagtgaaaaacaggctttcattaagtccacatcttaatcccccaaccttattttccccctcaaggcctgaagttcctcaaatgtaaattctctcacaaagtcttttctgggacataagcccctctaccatggaggaggcgaaggctctggtttgtgctgtaatgcgaggagagaataagaatacagagccatgactgatggcaggagcactggggggcaggagttggagggttccgcatagacgtatttacctttctaagtgaggtacagatgagtttcagatgtgacacgaggcagcagccacattagacgtgacagcaatcccgccgccaagtttcccccgcttggaaagttctggagtccggagccgtggccactgggt

SEQ ID NO: 2158 - DNA, 403 bp, Homo sapiens
gacattccagaaagttttctgcctccacaatctttcaaatgccaacacaaataggaaaagcagaaccccttaaagggacagctcaggttttctctggagcaacttgaaattaacagatttgctgttccaacagcggaaaatgcccatttcaacgttggtgagtgctgtatgtttaacatacggaagcaaaacgacgagaaagccgtaacacctaaccattttctacttttaagttgtttctatgactttcaagacaacagaactcctgggatttttctttaaccattttttatcatggaaacatttccggccttttgttctctagtgacattccaactccccaagcttcaaactcctgttccccgactctatttttaaaatctcgaaattcttgcgaaaaatc

SEQ ID NO: 2159 - DNA, 416 bp, Homo sapiens
aagcagtaataaatggcaaaactacaggagcagtcaactatgaagactgagaagcctaggaatgaaattcagtactgatcaagtaaaagttacttcagagttaatgacagacaccaacgatacatcgatactgcaccaaatggtaacaggtatgacagaaatcaatcatcggccgcccacacacacgagtgggaaggtgacctcactgtccccaaatacagaatggcctcacctacctcctaccttcttctcatgctgttcacctctcccttggctcagcaccccttgccagttctcccaaggtcctctctgccagttgaaggcttccctgatcgccatcctcaatcccccaggactcacaggttgaaagagtcgcagccaagagttagggaacctgaccatgagccaatcccagt

SEQ ID NO: 2160 - DNA, 351 bp, Homo sapiens
gatttttaaaagttttattacaaaatttttattttattcaaaatacacatgctatctttgtccacatttcaatccaaaccacccagtcacccccaattccaaaaaacaggcctttgttttataacatcgctgaaaacaagccatttttgacgtgggtttggagtcattattctatgacactcactctgccctaaggggactggattttgtaaggctgcttactgtggggatgtccacgggagtcagtgactctcataacagagtgggactgctttaggaaatccaagttaacattaggaggtgacaccagtgggcacactttggtagaaaagtactgcaccgtgagctccc

SEQ ID NO: 2161 - DNA, 608 bp, Homo sapiens
gtttgcttgtttttgtttttggtgaagaaaactaatctgggcaaatagctcatgatgaaatttgaccagaaaatttctgaaagtgtccagtagtgtttttgtctctctgatcccactgagccactccttcacaatcttgggggctgcatgcccacctccaaggtatgagagcatcacctggcacttctgagaagcctcacacaggactcctagaggcctacctccagttgcttcctaagctgccactgtccacaggaccctctccccagaagctaaacaacttgccaaactaagaactaaaatctgtattttcaaaatatccgtgaagtaaagagagagaaaacaatcataaacttctttagtggttaatttttgaaaaagaaagattctttacttttcaacagctctgagggacaatgctctccccagatctccatcactgaaaatctattcaatctccagcacagataacttcaagtgccctaacatccacatcccaactgactgacgtttcttccttttcttagcactcaagcctctcacaggcctcccttgattccaccttgaatacatctgctgtcttgtgctcattaaccattgttagactc

SEQ ID NO: 2162 - DNA, 383 bp, Homo sapiens
cagcctggggaatcccaaactatatctctagtaacaaggaaaccattttaccggaatttttattaacatggaaaagttctgtcaattaatcagacttcactgtccatatcactttcaaccttttgggaaggtagaaagatggaattctgaaactaaagttggtaaagttcacagagatcgtcaaacttgcatggtctaaggtatttcttctttctgtggttcatgagttagtaacagctaaaccaagtgtctaggaatattagctctgattctagaaatctacacttatttaactaaatgctgtaaggactcaggaaatccattctttcaacaaaagttactgaagactttccccattagtatcctaaacaatgtctgcaaaa

SEQ ID NO: 2163 - DNA, 404 bp, Homo sapiens
ctgtctcaggactttcagggaaaacaatgttgacttaccaatgggcattttcaaagactctaagttggtatgtcagtcagtgtacagacaacgtgatccgcaaggcacgggcaccaccctgccgtgaaccacatctcagccaatcttccgcaaagaaatgtacccaaaaacttttctgtaaattcaggaaggtgatccacaccttccacattttgttttgaaacaatgatggtattttaaaagttcttcaaattaacaaaagtgatatcagaaatataaacatttctaaaacagagcgggctgtgaggagtgattttgccaaacttaagtcagtagcacttgacttatatctgcttttagtctgcggtggcaccacgcttaccaaggcacagtatccccttgct

SEQ ID NO: 2164 - DNA, 525 bp, Homo sapiens
caaaaaaaaagtacctaaggctgaaaagtacaaatcacaggcatcaagaaaaagcagtttgtttgtgatgtttttcttactctgcaagcaagccaaaaatttagctaacacttttactgtattccactagattcgagacagcctgggtaagaagtgaccctggctgcccagtacaaacagctgggaagcccaaggagcactcaagaccaatgagatcaaaatccctagggtcagggtcccggcatcactaatttttaaaatatctcagaaaattgcaacgtgcagctaaggcagagaaacttcaagtgaaaaccaggctctttaatctaaaatgcaggaatgctgggtgaaaggcagtgacactggtgggcaagatttaaaaagaagtcaatctctctctccttacattttcttttttctggctcagagaaacatccaagtatcactattcccaacagaggacactgttcaccagagtgtgaatggtaagactgtgtctgtacaccaaccaagagcaaccatgct

SEQ ID NO: 2165 - DNA, 392 bp, Homo sapiens
aaatagaactgtcttatagatttattaatgaaaaatactttacaaaaacagtatgtttggcctaaaatagttcagctgactctgagggtttacattgacgactgagcaagtggcaataatggctgtgttattgaggacagaaggctgtgttagtgtgcctgactccatctgttcaaaagggtgaatgttatgttggcagctccgcattctaggcctaaggtttggagggcacagggaatgctgacaggccataatacctgggcaggggggctgccctgatgatgtcatcagaaccatgaccacagggctacatgtccccccaaggatgggagacagggaagacaaagggtcaggtaatagggataggtggataaaacaaagagtagaagttg

SEQ ID NO: 2166 - DNA, 419 bp, Homo sapiens
aagtggcacgccatcatttatttacagagaaaggtatcactttaacaaaatcaggagtccttcgggggcagattattctgtaataccactttcattatcagagaactctcgatacaaagtgttctacaaaactacaagaagaatcaggctagccttttaaggacatcatcaaaaatcaggcctacccaataaaggcagaggcagagctctataaaatttggtgaatccaggaccacttaaacaagtcagacatatagatgatggaagacatgggacgtgaatttcttttgctggctttctcattcctcctattctatcacttaaagcatttacctgccagcccccaacatcccagatctctctccactacccttggagagctcatttcttctcctggctccaaatcttgcccctgtaga

SEQ ID NO: 2167 - DNA, 503 bp, Homo sapiens
cttgccagaagggttgatttttaattatgtgtatatacaaacttctctattttaacattcaacatattcaggattaattctagaaagatgctatagctgatttataaaacaaaatgatttaggatcagaaagaaaataggggcacacaatttcatgtagtctctccctaactacccccaaccatagcatcacaaggtttttttttttttcctaatgccacaattgaaacctgtattaacttaaaagttgacactaaaggcaggaattaagaagtcattttttatggcttttaagcacttgaatgctttagaacccccttgaaaatgctagtgaacaggtcttattcctttaaatgttgctttgatttgaatcttggtgaaatctagattccctattaaatagctgcatgctaattttggagaaagtacaatttaaaacctttaacaactactctattgactctgaagaaggggactttagcatgtcgctgtttgggctagaga

SEQ ID NO: 2168 - DNA, 438 bp, Homo sapiens
gtgagattagaagtgactgggttttttttttaattaattataaacttattacattgattttttacaacagacataactaaacataaaacaaaaaggagcaaaagactttgctgaaacatcttcataggagtccagaatataaactgaaacagagcacatacaccagaaagaccttcccggaagattgtggaaccaggtccccagagcagaaagtacaggagagactcataactctccaggcccagtgctgggggaacccctcatgggagcagctgtaatgaggcctggaaactggacactgctgagccctgacatccagacctcaatgccctgactcagcccatggcagcgaccccttcaaacaggctccatgtgggcctgtaatcaggaaagactagagcatccaggagtggagatttgattctgagatgctgggag

SEQ ID NO: 2169 - DNA, 684 bp, Homo sapiens
aataggtgatatgggtattttattttcttcaagtattaaagaattgttttctgttgggggaccgccttcattcatagccaagttttcacaagcttgtagtgggctcctaactctgtcaactttttgggaaacactaaatgttttattaacattctgaatatttgaaacccttctgttgtgacttgtagaggctgaaattttcttctttttaatggtatcccaaagactcctctttttctttttctgctcttctgcatttcctagtaatatagcttggtgtttcagaacatcatttacaagaaatgtcataatctctcttactcggccttctttgagtggtgtccagttaacagaaataacaattttctctttaggctgcaacacgaaacagcgctgcgacacactgaagcccaggtccgcggccgggaagtgggagatcttcacttctgccacctcctcgttagggttgtctagggccagagacagcgtccgtgaggctcccaggagaacgtccccgaagcaaaggaaaggagacctgcagaagtggctgagagacaggaccggcggggaagacgcctcctcctcggccgcggggccccgcagccccgcgggcggcctccgctcggtcgggctcacttcccagcagcctcgccccactcgccggttcgccatggcagattcgag

SEQ ID NO: 2170 - DNA, 450 bp, Homo sapiens
gttaacattaacacatgctttattcaagagataatattcaaagagttaaatcctaagagttatccaccctacagtaaaaaggggaagtgggtaccacttatgacatgtacataaattccacttttatatttctgaataaagctgcaattgcttctttgatagagccatttcttaaaacttttgctaataaggctatgtgaactgtgttcagaaactttgacaacatgcacactcactcctctcaaagtcagtacccaggattttcactccaggctgagtacctattaagtaactaggacttcagactgcatgttactatatgaattcaatttgactcacctccagtatgtttatctaccacaactattgtttaaaataatcagatgaatgtttatcataactttataactcccccaaattatacttcagtatttaacatggtagtttcaa

SEQ ID NO: 2171 - DNA, 431 bp, Homo sapiens
attcatgagggatctgattttattttctttttcaactttaatttttgattcagtgggtacacatacaggttttattacctgagtatattgtgtgatgctgaggtttggtgtacagataaagcgatctgattttatactcttatgcagtggatctaccactactacaatgactgctacagggctgctaatgtttctgaatattgtctaagtacttctagaaataggaaagaagatcacagaatcataaattcttctatcttaaaggagccttcaggataattattattttacaaaaaaatgcagctaggctattgtatacatcaaacaggctgttttttctcatggtgaactgaatctgcttcagtggaactttccccattctgtctgaggtctccctttggacacaatgtagaataaatctattgctctcc

SEQ ID NO: 2172 - DNA, 403 bp, Homo sapiens
gccaaaggaagcaagctttattgaatttacaacgtagaaaatatttgtagttccttagacatttgcattgctataaaaattacactttatggtataattattaaggtttgaagagaaataaacagtataaacgaaatatggcccacacaatgaaaatgtaaaccatataaatcaaaatcataaaacaattattcaatactcagaggcctacttaatatatacatatgaaatttcttacacacacacaataaatgcccacaaaaaccatcactgaagccgatcactgtacaaatatgaaaataaatctttatctttaacctcaattttatcttcagcaggagggttgtgcaacttgggtttatgcagatcacatcaagtgttaaataatcaaatgtcacatatg

SEQ ID NO: 2173 - DNA, 405 bp, Homo sapiens
aaccgcaggaaagtacatttctgttgcttaggccgctcagcctgtggcactttgttacagcttctcacccagttcaggcccttttaattgattgctgggcctttgcagttgtttttgcttctaatatattcatctctcaatttatttctggaggctgccacccgaggggcagaacttcaattgtgtccctaatgggaaaccttgctgggatcatgtggtctacagcacaaggttgctaaagcatcttctgccagaattctgtgagtatctggttaggtgggtctggaatatactgagtttaaaaaagttaaataggtttctttactgcaagatgtttcagagactttaatatgctactctgctgtatgaatctccaggcaggaaatcttataaaatgtgtttctg

SEQ ID NO: 2174 - DNA, 386 bp, Homo sapiens
ccctgagcgaactgcatccatataatttatttcacagggactttatttcttgccatctcacatggcatcacactggtccattatgctgatggcaacttgtgaaaggaagcaccaggcatgctctgggggcagagtggggcttccaaggcctcccgagcccagcgggcctggctggctctcaactgttctgctctcagcccctgtggggctggcatggggctggacaccagctctcctccctcttcccagaagcacccgcatggctgtggcagctcacacctaggcctccagcatgtccagaggaaagcttcactcctggtgggagtccaggttagctgaggatgggatctcccacgagcggccacaatgggaccctggcacactct

SEQ ID NO: 2175 - DNA, 372 bp, Homo sapiens
aagattgatttatatttaatgtaatgaggcttttctagcagcatttaatacatcactcaaagaacaagtcttaactgagaagtacagaatacctcattttcacagtaatttttttttaaagtcccagtgatgaaaactataaggcagcttcctcaaaggaagttaacactgatgaatccagtgcagccggtgttttccatatgaggtgataaaatctttatcacatccagctggactgtcctgtatgttagtctgagtctttggaacagttattcctttttattaattgtatggttgttatgcagccatggaaggaaaaagctgaacatcaaaatcatcaacaatatacctaaagaaggagccagccagtat

SEQ ID NO: 2176 - DNA, 530 bp, Homo sapiens
gacaggcacatgtttatctagcggtcagtagaagtcacaacccaggcatccaaaccagttagtatgagttattactaagtcaggtgaaaagagctaggtggttatacatttgatctcttaaataacacaggaccaccaaataaataataataaaaaggcacattgtcgttttcatcctggggaccccagtgagagtagggacctcaggtaggctccttggaattggaactgttgtcctgaagagggcaagcctctgtttaacactctgaatccagggcttgctgcaaccctatgctaggtgactcaggcctctctcctctcattacaggctggctaaccgcacagcctaagttgaggagcacatgagctgtcatgactgtatccagattggaattcatcattttcaatgtcttgcccttagaatgagtccactgagcaatgtgaagttggcggtgtccaggaaaacctcctgctgttccttctgtataattcctcttctttaggatttctggttaggaacacggacgggt

SEQ ID NO: 2177 - DNA, 437 bp, Homo sapiens
gctttaaatcccgtatttattgcccaaagctcattagtattacacaaatcacatagattgagaaattttctgaggttaaaaagacgctgcaaaggcccctgggagtggctgaggcttgcgtgcgggggcctcactctcactgggccaggcttgaagaccaccctgggtctgtccaccagcctttttcctcctctaggctcctgcccttttcccaggccagaggccagaacaccaaagaagtcggctcataaccaggtgaaaggggtccgtcggccagctcgactccacggccagcttgacatcttggtccctgcaccctcacactgctgtctgggaatggaagaagggcatccccaagcctgagggcatgtttgaagtgaccagaggagggccaggcagggacaccaggggtgcagcaccatcgcaggcgtggcttg

SEQ ID NO: 2178 - DNA, 393 bp, Homo sapiens
aacaaagttattggttaggcctaagagacccttggtatatcacctgaaatcttggtggaggttgatattgatttattactctaagtttggtatgcagactgttactggtctaagaatgagataaggagtttgtgccacaacgtaaaataaactaagacactaagcacattgcttagttctactgacatttttcaatgaagaaagcagtacatggatttatattctggttcaggttccttgtgccctagaagaccattaaaaacagtttgtggacaggttactttcagtagtactgctatagttgacaactgccatatccatggctgtctatcaattctttgcatagtcttcttacatttaaagaaatttccattttatgagtttcagcttccc

SEQ ID NO: 2179 - DNA, 443 bp, Homo sapiens
caaaatatgccttcttaatcagtggccctgaagagctctatgttctctcttaaggaccaatttgctattattgttgccaagtaaacaaaaaataccaacaagaactaagcacagatgagactttcctccaagaatcaggatcatcaagtattaaaatagatccctgaatagtttagagaataattggattatactctctcaaaatccctaaatcattctacttctgtaattgtatgagctactctatttttcccgtgactttttcctattgcccaagtttggcttttcttgacagcaggattctactttgttggatgctctttgaaaaagtctgtatttaatggtttttagaaaggttgtagctttcatccagcatttgcaggctctcagcttttgcttaaggatgaatgcgtctcaacacagtctcttctctttgtgatttc

SEQ ID NO: 2180 - DNA, 443 bp, Homo sapiens
gcctgacaaaactggacatctggatgtccctccagtctacttatatactcacagagagaataagtttaaatattaaagagaaaacacaaagatacttggaataaatgtgcatttaaaaccctgactaaaatatcaacataatgatcataattacaatggtaataaaaataattagtacaataatattatctttatgagcagcatggaaatttcattcctgatctggaagaataaaaggaaagaaaatgtcaggtgaaagagtaagtagcctccaacttaagcagacagaataattttctttaaaatgaaaagaacattttaagctgtctttccccctaaaagatcagatctagaaagggctggaaatgaactgtgcccaggaatctgggggtgctctccagtaaggcgaactgaggctcatttgcagccaagacttggaactc

SEQ ID NO: 2181 - DNA, 464 bp, Homo sapiens
caaaagaaaaaataaattaaatttattaaagttttaatacaaagcatcccatttgaagtatagttctgaagaaatgtttatgagctagggtcctgtcaagagaatattctatggcaatggctcactctgtttgtgtactcttacagatcctctcctgaagcaacagaaagaggtgtagattgaatttaaacaatatccaacgaaaccttcattgtatttgtttcatactttttttagaacgtctcaaatcctttttctgcttgaaaataggagaattcaaaaaacacaaatctgtaaaagggtcccctcttctcagtttcgaagcgagggtgggctccttatagttcacgctggctgtgcacctacgtttaggcagagccactgctgggcttgctttattcttttttggagaaagagaaagtcttctgattttcacaacaggatacaaggagacattggtgata

SEQ ID NO: 2182 - DNA, 484 bp, Homo sapiens
gggaaaggtagttttggcacatttcttttctgactacagtgatgtaagtagatagcaaaatactggattttgcacatgctgccctaagaatcactgctgccattgtagtttgctgtattgtctgtattttatatttgattatttgggcttgagtgaaaggtagatttatttccatttgcaggtgttgcacataaaacactccctctttataagaaaaatcataaatgcatataaaatagaaaatatttggagattgcttatctgaaagtcttgctttcttatacacatggttctctcatattaagcctggtagtaactttttagtgtaattacctttagcacttcaaagacgaggaagtaaggaagggaatgcaagactagtgcataaaaatgcaataggtgtcatatgtacagcattcttcttagagttgccttttcatcccaattacagtgagtctgatttccatcctgtatttgcataata

SEQ ID NO: 2183 - DNA, 387 bp, Homo sapiens
cacgtaaaaaataaaatttatttctttttacacaagcagcaaggcatgccctatcctgacataatttcattccaaatggaaatcagatcaaggccctaaagacacagtgtgaaggtgagagggttgccttggccagcctggcttggaggggatgctgaccgggccgccttcctcctgcagctctgacctggtcattcccttccaggagtgacgccagctcccggaggtgctccagctgctggagacgattgttcgaggtgaggaccagcctgtgcacctcctcatccactcggtcgtacaggcttgtggcggcctccagggtgtcccggctgtcttctgtgccaagctcttctctcctcagccgcgccaggacggtgcccccctcca

SEQ ID NO: 2184 - DNA, 419 bp, Homo sapiens
gtcggttaatttacactttatttttttaaaaagttgatttaaaaaaagaaacaacacaagtttagaatccataaaatgtcagcaatgctgatgtgcactggactgaaacatcttgatcatcttctgatagaagtaatattccatacaaaaagattcttagattccattttttgcttcattattgtttgtggcttgctttctttgagcaataaaggggtacatacacttgtccgctcctaggaaccgatacatgcacacaactgcttcaaatggtaggatgctcttcatgaaggtcacgatgtacatgaggcggggagtgcagatcatgggctggtcagtgaggatggccttcatggcctgcttcacacagtaatcaggcttcagaggtggcagaaaaggctcaatttctttcctgattc

SEQ ID NO: 2185 - DNA, 668 bp, Homo sapiens
ctatacagtatttgtcagctgtttttattcttcagtttatcatcttatatttggctctcaatttcacccataaattattgatggcttattatacgccaagtaccctgcgctccgctttttgtggtatccctcttcggagcgagaagtcacttagaattttaccccatcttccccacttgggaatcggaagggttcatagctaagttttgttatttataagcacgccggctcttctctatccctctctccaccaaccccatttcaaggttggtccctcccagcggacgacagtgatgaattcctcttggggacagccctcccgcaactaacggtggctccatcgacgctctggtctccttgctgctcgctgggaattcgggtgggacgttttccaaagtttggattccacggcacattcctccctcggaaaggcacaaccggctcggcgtgtcagctcagctggactcacgccggtgcggggccgcagctccggttctcgctgggcggctgcggagggctgggcgattctctcagcgtcgcgaggcgacccgggcagcagcaaacttctccgcttcccctcttcgggacgcggcacctcttctgcccttgagcactccgcaggaacttcccccggcctcggtctcgctccgaaataaccgagccagctc

SEQ ID NO: 2186 - DNA, 400 bp, Homo sapiens
cacatgccatttatttttatttgtacaaatttacattaattttactacatacatatatattttaagcgttcataacaaacttagaaaatagcggatgaaatccagtacaccaatcatctagtcttagcaaatactattattttaccataattattccagatccttctttaaaaaaaaaaatgttactaacataactaaagtaaccaaacataaccaccaaaccactgtctcaccccaatgctatccacttcctgccttattatactaacaatatcctgaagcgtatagaacttttagttaatatttttatattttaccacacatgtctatgccattaccaatatagataatgttctttggagtttttaacttacataagtgagaggatactgaccatgtt

SEQ ID NO: 2187 - DNA, 426 bp, Homo sapiens
actttcaaataaggaaggcaatttattgtagtgaaattacattgaagttttatatatgacccccaatgcatataaaatcatttacctccacattataggataggatatcatgaactacaaagatactcaaagtgctatagatgagttaatattgatgtaatacattttcattaatctacccacatttaattggatgattgaaaggacacgttgaagtgtttttcatgatttttgctacggccccagcttttactggagtttttaatgcctttgatgactccagacactcaactctgttccttgcagtctgtttctttcttctatggtggtgattagttattgcaagactgcttatatagagtaatatatagtttactctggtatggagtaaacttataccagagatttaaacatttctccctaaat

SEQ ID NO: 2188 - DNA, 429 bp, Homo sapiens
gaactcgagattatttttattatagtcaatgtttttcacacacacacacatatatatacacacacacacacatctaaaatgagtcagattctctgattactcttatgttcattatgtaaactccagtttagaatatttcatctatttaatctgcaatttctagtatattggcataggtttgccgcctgttccattgttagttttggaaaacgtgtgtacgatctgtagggctgtctgctggctcactcccatatggaaatgcatgcctgctctttctttctctttttcattgtagttagaattcatgagtgtgattcatgttttcaagaatgagcttcactggctttgttgaattttcaagctttggtttttcctcatgaacaactcctcttattattgttattattccctttcttacgccttcatttg

SEQ ID NO: 2189 - DNA, 401 bp, Homo sapiens
gataggctcagcagcatttattttctagttttaagaaaatttgattattcttgtatgaggtctaaagtgtgtatctatcagtccaatcaagcttttaaattttcggaaatactaaatttctaaatcataaagcgtcatttaaaaataattaattgtttcagtccaaaaatagcgtgggtcaaactggaattttcaaagtgacgtatctgtggatgatatgcttatggtaccaaaaagactctcaaaaaccaatactcccacgggcaagggaatagccaagtttgttgcggtttccaatgaatgacatcagccctgtgtaggtctcaatcaaaatgggttcagttaacaccatcagtttctttcctcttccagatccagttgaattcttgtgggcattctgg

SEQ ID NO: 2190 - DNA, 496 bp, Homo sapiens
aaggagtttctaccattaacattttatttaaaggctttgggactctgaagtataatgtttgtgaaatgctatgagccagaccctccacactgaaaattcccagtgtaaattaatttgttaaatgctcttagaattcctgcaataaagaacacctatctaaccttagttatccctgtgtttcccaaatatatcttactttggagcactttttttttagtaccgatttacatcctgggaaatggtgtttaccatgctttaaaaaaaaactgtggtaaaataaagataagatttaccatcttaaccattttagagtgtacagttgagttggcatacagcattcacataacttaactgtgcaaccaatccacaggactttttatcttgcaaaactgaaacactatacccattaaacaactcctcatttcctcctcccccagtccttggcaactaccattctacttgtttctatgcatttgactgctctagatacttcaca

SEQ ID NO: 2191 - DNA, 390 bp, Homo sapiens
cagattttagaatatttgcatcatacttaccagctgaacttcccaaatctgaaaatctgaaacctaaatactcaaatgagcatttcctttgagcatcatgtgttgctgctcataaagttttagattttggagcatttcagatcttcagatttaagaagctcaatgtgtaatttcaacaaaagacttgaacaaaaaaaaaaatttatgtgatactgactaaatgtccaatttgtgatttgccaactacctaaaaacaaagggctgaatgatttagtttatttcagtttaaccttctcaatataaagattatttaacctctcctttagttattctttaacaaacaggttacacaaaaagtacaattacttctactaaattaaatatcttacc

SEQ ID NO: 2192 - DNA, 486 bp, Homo sapiens
aaactagaaccaaatttatttatcagaattattgagttggatgaaacagaaaataagccaacagaacacttaaaaatacaagtttattttctccatattgttaagtctaattatgatttatttcaaaatcatgaaaagcagagcctagcataccaaatgctaggtcagatttgctctggaaacttactttctagattattttttggacttacttaaaaaataattaatttccattaatatagcactaatagcctccaaattatactgcagaattcctatatgtaaccttttttaaaaaaataattcatcacctgaaaaagatatatttactacagttaagtttttaagtcaagagttttctctgggaattgatatattttatctataatgtctccacttctccatactttcatcaaagtgtcactgaagcagctaaatgcagtcctgtggggctaggtctacaacatctgcttaggtttattttag

SEQ ID NO: 2193 - DNA, 420 bp, Homo sapiens
caagtacaagatgttaccactgacaaaagggtctcatatgaatgatggaggtttctgttaccgtatgcccataaaggggcctgaaaccaaatatgatttgaatagaaaagaccttgggaaacataagtagcactttggggctaagctgcgaaggcactcgtattgtacaagtaatttcgaagagagcctaaatttgctacccccctgcttctacagggtataccagatttttgctgtcttgggacactgagctcatggaagcctgtggaggaaactaaccggtaagctggggatctaggtagtcatccaagagtctggagggagaagaaatttgttacttccacagctggggtcctgtagaaccatactaatgtacaaatggatgctgaaaaatacctgcatagtttcaaaacaaaactc

SEQ ID NO: 2194 - DNA, 495 bp, Homo sapiens
atgaataaccaatgtttacttcatacaggagctacttaaggaggtcactatatctcaatgtgaaaactccaatgaatcagtcactgtgttcaactgaaaccaacctagagaaccttatctctctgcataaaatgctcctgctgcatggtttttcagggccattgtgaaattctgtgatgggggaacaggaaatctggacacagaagggtgggactaaaatgagcctgtgccgcttttttttttttttccatgcctcaatgtcgtcatagtcctggggtttgtatgcagcatctcaggaccagaagagcccattgggaacctccatctcaggccagagcatctgtctggccttgtcgctgagggcgtggggctggcactgacccatggtaggttgcctgcatgagggccgtccagccatgcacgctgtcctgcttgtcaacatccgcgtgcctctccaccagcagctgcaccagagccagctgccccgtaacagct

SEQ ID NO: 2195 - DNA, 427 bp, Homo sapiens
ggtcctagataggcttagttgtactattcttcaaccggcccttttccctcaaatggggaaaaatcagaaaccagagagggaatggcgtttccactgtttctctctttgtgactttcagaaccaaggtatttagtactcgatgctgttgggattcacttcttagcttggagcaaggaatcttcattctgtgtgacctaacagttcagaagctcctatcccctcatgagataccttacgtggaagagaaaggttggagttctgcatcgtagtcagcactagcaacctgggtcattcatttaaagaactatctttaatatttactctcatgactaattgcccatgtgcatgtgccaaggcaaaacacaaaagtgactgtttccaaatgactgtcttctgcttttaattcctacttgccttcagttctaac

SEQ ID NO: 2196 - DNA, 433 bp, Homo sapiens
cagacttttggcttgtttgaaaccagtaactggaagaagacactgccggacctgaggattgcacaactccgggaaagtcacctcattccactgataacagaaccaagcgtcagcaggctttcaacagcccggaactcagctaaaatctgcagacctcagaaccgccagcagcacgaggacagagtcggggaggtgtagctggacaacagctcatgaggcagaagagctgtgtcacaggtgtcagctgagcacaagccctgtctgaggccgtggtgactggcgacagccgggcagtggagggccttggaagctgaagggtggtcttggcatggactctggtccttggggtgcaggctcttgggtcccagttctgctcggggtggtcctgtgaagcactagactcctagcgggtcatctgggaggttctagcaga

SEQ ID NO: 2197 - DNA, 441 bp, Homo sapiens
gtacgaaatgtgttagaactcctcttgcctatgttaaaatgtgaatgggtcagtctccctccactgtaggttgagcactctcccagggggcccaggactgctggggttggcgtgctgctccctgcaggtgcagccgtgagtctacggccctgcccctcagctccccggctgcacagtgctccgtccccaggccgctgaccacactcacaaccccttgttgtacaccactgtccggctgctcgtggcctgggctatctccggctctaattgggatgtttcaatctctgacatttgcgggaagaggctgatggccagcggcagggccaggccgaaggctgccaggcacacgaggctttgcacagggaggagcagccgggggcgtgcctgcaggagagccgtcttctccagcatggacatgacgatcgggggtagcaccaggat

SEQ ID NO: 2198 - DNA, 435 bp, Homo sapiens
ggtggcttaaagaacaggcctttattatcatgagcaatgtgaagcaggcagttccagagctgggtgacttggatattggatatatccataacgagcatcatatgaaatcaatcaacacaggtaagtctctgcaggctatttgcagaatccttctgtgtcctcttgaacaaagctgattatttccatgccatttacatcaaaagagaggaaattaagacccctagtgggctgtgagaccactcacaacaccttttagggactggggagagaagagaggtctgcccgtcacaagcatgctggggtaaatggtaaacgcagtatgattctgccagatggtaggagcagatggctcctgccccagcaaaggccaatagccatttaaaaagtgcaacacagctgctgaaagcatctcacatacttggcactcacagggaa

SEQ ID NO: 2199 - DNA, 485 bp, Homo sapiens
gacacacttacttaatgtgtttattcaaagtaagagtctttatagatcttttcactaattaaatacagttgggtgtctgctgaatttcccttgaaaacattttgaagtgaaaaaagtcagtactgagtactgtacatttgtgttgattaacatttggacacaaatatacttttaacaccaatagagctgaaagactatgcctttatcttggatttcatagatttccccttccccccagtgacttatcttacaaggcaaacaccagcaggcaaaggggatctgtagaaatgtgcaccctggtttcctcctccatctcttctaccaatgtgggaagaaagccaatgcttcccagcactttctgaaggtggaatctcctcctctttacttaatgttggagaaaagtggccaccagtactcgatcattgtagattcggaatctcgccatctaaaccagacttcaaaagtgcactttcgggtctacttag

SEQ ID NO: 2200 - DNA, 462 bp, Homo sapiens
caaacaagagaggctttatttagatcaccaaaaagaacattttacagaaagggaaccgtaacattacacaaaaaagtatagctgtaaaattgcaaacaagaaaggcaatgctttctttagatcaccaaaaataatgtttcacagagaaggaaccgtcagaagcaaattatagctgcaaattttcttttgccatcaatatggattccctctaaaatactttgagactactttgcagttttcaagtacaaactaaaccttgttggacagttgctcagcttcatcaagagaatgaaaccaatttgcaaaaaaaattttgtttaatgctaacaaataacgaaacaatgtggttcttgctgactaactgcaatgtctgctgaaatggcctaacctatgtacacttccatgaacatttcactgtgaacagttgctttttacctgccatcacagatggcctacaaagta

SEQ ID NO: 2201 - DNA, 470 bp, Homo sapiens
gactttgcaggatgtgctttattttaagtcagccctgaacccaaactacacaggatcaatttttgacatattctagtccattcaatgattcttctcagaaactgtatcttaatatggaatgaaaactacatttcaatcataaatttttcatgctacattgttatttaatgaagaggttgtattaccaataataataatttaagaaaaggccatttttatttccccaagctcaatatacatatttctttcataattatgaacttaaaaaacccgtctcagatgtaaaaatgtgaattggaatatgtaaactctttgatatacctgaaaaacaggaaggaaaatgtcacatactggaaaaaccattgccttaaatcatggaaatgggaaaaagcacgttaagggaaggggaaggcagaagagcggtcctgacctcagttattaaagagttacaaagtattctaggtcccact

SEQ ID NO: 2202 - DNA, 425 bp, Homo sapiens
aaatgaatttaatctctctctagaaacagtgcactgattttacaaatgtccacatttggttttcagtttaccaagatgatgccagtatagctagtgagatgcagcaccccatcctcagccccctcgcctctggaagagacaccagactgcaaagggcaccgcgtacagaagctaacggaacttgaatgacaagacaaaaagagcagaatcagttagtgtgacacaacattctaacatgcctgattcttacatcaaatatggtaactttggggttggtagggggagacaaacaaggagaatccacttgggaacaatttgatgaagtttgcaaatcagcactttacccccaaattaacaacagcttgtatggaaaaaaaaatgctcttttaaaagtatatggtttggacaggtatatttgttttctc

SEQ ID NO: 2203 - DNA, 654 bp, Homo sapiens
accatcacttttttatttggcagtaatagtaatacatccatgttacagtgcttattttggctaaagagccagtgcaattttttctgctactgtagtgttttacttttacacaaattaatgagtacagtccttacatttaggagacagaaacatttactgacatcagctaagtaaagctaatacatggttgttcacaaactaaacaaaacaataacataatatactcattaggaacaaagtagggatgttcttatttccactaatcacagattatataaattcttaaatttcacatacatatttctaaatctaagcaaaaaaattagaattcagcttaattcctataatcattttgaaatttacatcaaataatttctgaatatatattcacattaaaataaaagtaaatgggttatataaacataatttaaaatttctgattatgaaaagttatagagaagtacattaaatgttactttggcattcctatttcctaggcttacaggaattattaagaattcctttgtaatgcaaataatcactctcttggaaattaaatttaagtagaaaatgttacattttaaggcaagaaaacatttgtaaatatttttataaaggcatttaattcaacaaattaacggaatcatagtaaat

SEQ ID NO: 2204 - DNA, 846 bp, Homo sapiens
ggtttgattgtcatttatttcttttaaataaactccctctaaatgcaggaagtaagtataatgagaaaccacagaatgtggctctccaaatttcctcagtagccctacctatgtattttaaattatcatagaaaaacaaacaaaacgacagcacaagtagcagtgcagccatgactgtcatcatttatattagttccctgacttactatacatccctggtataattgatgcatttgtggatgttccattatggttgacacgtactgtaagtgtacaacaacctgacccttggtatggtttgcaaacatgtccatattgcacagaatgaacttcttgctgcaaataatatatctaacatacatcctttcaaaatgtaacatccttaactagttaacatagtctagagtctaggggcaaagacaagcaaatattgatgatttagaaatgcagtagcacgttaggctacaacatggttaattccaagtcacttcatattttgcaagttctttgctcctatgattgaatacttcaaacatgtatcttatctttcctcctgagtatccaaaagtgctttggagagcaaaagtgctttgtctccccatttcacagaagcaaggaggggggatagggctgtagcaagaagggccagctgctctagagaaaatgtggcagtaccagggtaaatgttagcatccttaagcgggtatcttcagccagcaacactggtgtatgggggctagtgacggtaggatttcatgtgtaacctaagaacaactctcttcagggcatgttttctaataatcttaaaaggattcctcagcttggctctacctaactggaaaatgg

SEQ ID NO: 2205 - DNA, 501 bp, Homo sapiens
aatagccacactgattgttcatttctttaatttttaaaaatgagtaagcagacaatcttgcaccctttgaatgcccaataaaaatgttcattatgcaaaacagtacaacctttttcattttttaataatactgtaaatatctcagaaaggatgtattgtttctaatgaatatcaaaaaagtcatcacaatgacatgttcccctgcccccacattgccctccccacccccaaagttacccaaatactagtaggaaattacaaaaaacaaaaagcaacaatccaccctccgccctgccccatgagtagtgttaagtgagtcaagcgttagccacattacgacgtgtgtgtgtgtcggcgatggcggaccacagggatctgtgcatccgtgagagttggtgtggagaaccggtagcagcagcagtgggaagcctccttgcctggggcctgctgggaagacagcagccgaggataaacacaagcagggccccagcctggcccttc

SEQ ID NO: 2206 - DNA, 387 bp, Homo sapiens
actaaaatgtctttaatgagagccttgaatcaagtaagcaaagtaggtgatgcccctgaacgggcctagctcctgcacagtcacagtccagccataggacccttgttccaggcagggcagtcgcacatcagggtcctcatctgagaactgaatcagggtcccctgagggtttagaaccctcaagcattctgatagaagctggtaagccctaggcagacctccccgggcaacagcatcccatgtgcctttgtccagcagtagttggaaagagcctgaagaagccacagcccccaggttctgagcatcggcgtgcatgaagtggaggcttgaggcagggtgtccagggcatagaggtgtttggcttgggcaccctccaggaggctattc

SEQ ID NO: 2207 - DNA, 420 bp, Homo sapiens
actttcccactactaacacatcccaatggtagatatgtataagtgaaatgagtgcgttcttcctgcccctataatgacaagcctgacagagaacacatcacacagaagaatgtgccaagaatcaagacctcttagaagaatgttagaaagttttctctccaaatggattctgtctaagtaggaaggccttggcaactagaaaggtctaagatcaaatttatgacttgaaaactctatggctttgggcaaattatctgaacttaattctggactcaatttcttatctacaaaatgggaattaaggcatcaacctcaaagggttgtttaaagaatgtgattatgtatttctgtaaagcacattgcaaagtatctgacacatagtaggtactctctgtaaatattagcttcacttctctcact

SEQ ID NO: 2208 - DNA, 406 bp, Homo sapiens
tcatatcacagtagaaaatataatttgttctaccatgggaaatagtataatggaatagatcacaatagtagtataataaaatagaatatccaagtgcaaaaacaattttcaagtaagtacacacactgtttgaaggtactttattaagatcaaagatttttcattacatttatttataaatccttcctagtcaaaataaaataataaaaatctgtatctttagaaagaacatagttttgtaagtctgagaaggttatgtttgtcagtttcaaattattacagtttagatacattcaatcattacacaataccaggaaggtcagccttaaagataccaagaacttccatattggtcagtaaaataagggtaaaaaattaaattttactttcacctttttatgtttga

SEQ ID NO: 2209 - DNA, 447 bp, Homo sapiens
aaggtttggtttcctttgaaatagaaattttggtaactcagctctacagccttcaatcaaagcaaagtactgacaatattgactgtactatcacctgggtcctcaggggacatcactagggtaggggtggaggtgcttttcaatccccagtgaaaggaggccaacttcagagagtgaacgaggaccccccagcatgccaagtcaacccatacgtggaacaacaacatgtacagagagctcaccccaggctcacaagacaaggacccaacagtacctctgcagggcacagaggtggagtgagtcacaacacccaaccctgcctgggtccctgtggacgtcggctttcattttctcacacagctgggaaggacactgcagcctgaggctataaggggagttcacagctgctgggcacactatttacagactcaggaatcccggagcagg

SEQ ID NO: 2210 - DNA, 792 bp, Homo sapiens
attgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagaaggtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcacgcggcgcgcagctctgattggcctcggcggcacccctcgtcccgcgactactttgtgtgctggggcggcgcgctccggtcctcccgctcagctggcggtctaggctgctctggggcagccttcggtccactgctctgcatcgcgggc

SEQ ID NO: 2211 - DNA, 453 bp, Homo sapiens
acaggtcttgggaaactttattataaaaatccaacggtatatataaactgcatttctctagcccaagatacttatgtgatactctacactgtagctcctatggcagaaataatatctgagaaacttcattttgaaaatttggacatattaagcattatagtacccgtcaaaatcttgatgttccccaaacttgagtcatctaggtgaggtcattgctgtcttcaaaaaattcagcaatctcctgtttactgttctagtgaacttaagtgaggttttcatttcaaatgctattatttctagaatttaccttaccctggtttattttcaaattcacctgttttttttcccttaatcgcttttgcccattttaaacagatggtttcactgttgctgactctttccctactgtttatatggcttacagtgttctggtgagatctcagtattctaaga

SEQ ID NO: 2212 - DNA, 370 bp, Homo sapiens
ttatcagggtccaagcctctgcatgtgctggcttgtttggctttattttagaaaccaaccaacatgtttcattagcactgacacagcaggggtcccctgctgccacctgacaatccagcgtcacttacactgcacccacgcaggccacaccttcaatggccacggcacgctagcccagagttagccacacagaaacacacttctcaccgcacaaaactcccttttgaaaaaaccaagcaatcgtcaggtcggaggagaatcactagccccccacagcgagaggggacaaagcttggtggccgaggccaggtccttgtggcccctcccggtggggttgaaggtgcccgggactcctcggggttgcatggct

SEQ ID NO: 2213 - DNA, 422 bp, Homo sapiens
cctgaaatagtgacagatattttcacccaaaccaaccaccaaaattaattaccatcttttaggtacacagggctatttaggccttttgacacataggaacgcatttgatattttttaacaattacacaagataaagcatgtaaataaattaatggaaaatgactattactattcacttcctacaatgctaccaactaccatatattgagtgtctctacccaattccaagcaccatatttgataatttcaatcttcacaaccctataaaacagacactctttttatccttgtttcacatatgaggaaattatagcttagagaggttaaataattctttgagttaaccagaccactggtggatctaggattcagacccaggcagtctgagaacagagctcctaattttagctactatttttttc

SEQ ID NO: 2214 - DNA, 357 bp, Homo sapiens
acaagtctatctttatttgtaaaaaataatatacaactaaagctaatttgatttttaaaatcgaagttcatttagtgataatgtacactttataataaaattgtagtaaaatactgacatttgatagttataaacaaagtatcattcatgtaaaaatcatgttatagcatgtaaaatttaattagaaaattcatagctcacaaaagtacatatattttgttgatagctcgagaacattatcataaatttacttaagatacagaacaaaattcacagttaggcttgacatttagtactataaaattttatgttggatccactgatacttttgttaataaggtgcacttgaaataattg

SEQ ID NO: 2215 - DNA, 505 bp, Homo sapiens
agttgtatttcttaggccatcccttttctacagagagaaccgcaagtcatcgtgagggtggaaagaatcgatagtactaaatgtcctttgcctaggctgcaagaggcacaatttcctttttcaatggatgaaagtaaaacggcaaactatttttgtttggactttgttgacttttgtgaggaaaccatatgacagctttaatatctaattttaaaattcagagcaggaaatgaggcaatcccgtacacaggccaagaaaaaaaccgtatcaaaatgtaaatatcaattccacattacagccagttaaagaacaatgggaagaccaagaaggagatggcagtgacagaagaaaggagaaggggaaataatgggcactaagaaagcagaaagagacatatttggagggagatggctaccgaaatctgggcttttcttagatcctctccaaggaaagttatcactggaaatacccaaggccctgattgtatgcactgtgctagggaga

SEQ ID NO: 2216 - DNA, 393 bp, Homo sapiens
caccgcacctggccctggtagtgatatttaatccaatccaacaactataggctgggttaaataaaaggtcattattgtctatattccaagtggaattaaatgtagtcacagagattcctaacattttccttatatttaagggaaatcacttctaaaaaaacacactaatcagaactgtgatgctctaattagaaacaactcatctggccaactatttgctgctcagagtttctcatttcttagatgaaaaaaactcatcagttatattcatgtgatcgcggctaaaaagtcagtattttctttttgttctaatgtggcttcatttgaaatttctcagattctacattgtactaattatgaataacaaattataaattaaaaactcttaaagag

SEQ ID NO: 2217 - DNA, 481 bp, Homo sapiens
ctctcacatatacacacacactctttctctctcacgttactttcactgtcactttctctctactggataacaggccaaaagtactggcactcatctttcactttcttccagctattcttcctacacatctctcactctcaggtaagttaaacatacaccacttccaaagccccagtctgccacagcacaaagaaaagccatgtctccacaggcagagcatgtacagctgagataagtcctctggggcctcacctttccctttcctctaaggaagagaatttcatctgccccatgagatcgagccctcaggggcttgggcactcacagatcaacatgttctaaggtagtgcaggggtcagcatcctaaaggcagcaccttggcaagatcccacatgtattttcttctcgaatccctaaaagtttccttgactgttgctccttactcacacacacacataaggcaggcacagaagggcagtgt

SEQ ID NO: 2218 - DNA, 576 bp, Homo sapiens
ataaatccaaagaatttaataattagcttaatgcacagggtttttttgtaccttgcccattcgctgaacttttaaaccctcctacatatgaaagaggaacagtactctttagtattacatcactgaaattatagaattgctcagacttgagacttttgacagtttttcatgagaagtcagttacattaaatcaccctttgtttgcttttctggacctatttttgctcaatcccagataaaactcctaacccaggtttgggctcagcactgatttggaagctaaaacgttttgagataaatacaaaatagagtcccgtcccaaatgacacaggcctttttaatagcaacgaaggtaaaataaagcaggacagcacgtcctgaggatgaagtgttttgcagactcttctcatcgatctggtcaagaagggagaaaggctttggcctccctgatcttctgcctcacgcctctgcaggacaaagtgaggctagcgtggtggcgcttcagggattccaggcgccggtgaagcagttcggtcttgtccaccttttcttacaagtcccgaagaagtgagtcct

SEQ ID NO: 2219 - DNA, 422 bp, Homo sapiens
gaacgtttttccatcattttcacaaatcagggatactcgtcccaattggcagggcccaccccaagactgccggcccctagagccctggccagggcccaggtctgggagctgccactgggaggcctgttgtgagtggtggtactggagctcagggtgcccccagttcctcttccggcccaggtggtcttcaccaggcctacagcagggggttgagggcaagcacccccttcctgaggatgaggtttccgtagagggccgtctcccccgttgccacaacagcaaaagccttcttagcccgttcataaaactcaaacctctctatctttgccagggctctcacacagccggccctgcgtaggatggactcgtactccgtccacactggggtctgcaggcccctctccttgtcgctgggcaccagc

SEQ ID NO: 2220 - DNA, 437 bp, Homo sapiens
gatcttttaaaattttattttataggtagcttcgataaaagcttcagatagacccacatactatacagagtttgtgaaatctacactttcaaatcataatattctctattttaggctattatatttagaagcatgacatctcaaatccttttattacaagtagttcttgcacataaatgttatatcacaatagcaaaaaaatgtaaacttcttttgcaaactacataaatactataatatctaccttgaagttattctcattttaaatcagaatacactctaaatgttttacatagaaaactctcgttggtagcctgtgtgtatgaaacatcattttttctttcttaactacttgtctttcatgttgcctacttaggtctctgaaggagaaaaattcaaaatagaacccagatcaaaattcagttcacatgtaagcc

SEQ ID NO: 2221 - DNA, 334 bp, Homo sapiens
actcttgtgaataggatcaatcttttttccaccactgcattcttcaactggttatcactggggcatagaaaaacaattatcttagtatgttgattttgtttgaacaactttcaaattgttgaactcttattaggtctaacaatctgttgtacattctctggtttctttatacagacaattgaatcagtctcgttgctttctttccagttcttatgcctcatttctgaattactgagcatgggtctgccccagaatgttcccaccattaatggtaaggctgctaaatattcacccttaactatgtttgccaaaggtttgataaatagccctttac

SEQ ID NO: 2222 - DNA, 434 bp, Homo sapiens
aattttaattcaaatttttatttaatcaaaagtcaaaatgtgaatacttgattagtggaattattgaattggtaaaacatacaatcaaaagtgaattcttagaactattattatgtcttaatccaatcccactgagctatatcttgatttcatatttttatcatgtctatagcttgtatcttaattgatataactcaaaagtaccatatagacatctcaaactaaagatcaccaggtgcttagtttcagagctgggttgtctgctatggaaaatatttcccagaatttagatgagattgggaaagatattgcccagaagagttcctccaaaatgccctttatatagagctcaggagaatctggaataatactgggctagatactgccctaaggccttgtacacttaaactaccacgatgtgcctttctgaatat

SEQ ID NO: 2223 - DNA, 418 bp, Homo sapiens
aatgttcccagaaatagtgtatttgtttgtttacatcttcagaggcaacggaccactaaatgttttgggtttaaaaacaatgtttaaaattatcaaatggtaaaagacatcatgaccaaagcttgggagatcagtgcctgtgtggagacccttcccaaaacagcttcaggcaaaggaagcctggccccctccgtgggccgagtgagatgcttgtgtgtgcagcaggtgcctctgtggtgctgggtgaagagcagacgacagggggggctttagaagtctccctggggcctacgctcccaagggcagactgctctcctccccatcccccaacagaggggcctgtgctctaagcactgcccgctgagcccagagctgccctccaggcacccgccgtcccaacggcccccatttacttgtc

SEQ ID NO: 2224 - DNA, 434 bp, Homo sapiens
actaccagcgtgaacaaccagcatttttattgcatttgagaatgcttataatgtcagtaattagtactgactacacaacatttttttattgtctgtatccgcagacatggaatgatggaattacagttgatgtcaaggaatgagtttcttttatgccttatcaaaacaaaacaaaacaaaacaaaaaaattcttgttactggcagcacatatacatgaagcaccatgctcacagtccggactgtatcatcttcatcaaggcttatgggtagcagagattgcgtgagctacactgggcccaagaaatgccttcagcattgtaaatctgattttcaggataaagaagcaaaactgactttgaagacatccagaatttcaggaggctatgtcattaaccaaaaggtaccaaaaagattcaaaatctgaataagcaca

SEQ ID NO: 2225 - DNA, 568 bp, Homo sapiens
aaggaataaggtgaatttttattaagtgaaaaaaatcaataacaatataggaatgatcacatctatacaaatacattgctacatttctacatataaaatgtataggaaaaagtctgaaagaatgcacaccaaattattctgtttttaggaaaagcagtaggattggtcagggcatggaatgtcggctaagtgaagtgagatttaaaatttttattctacatgattttctagtgttgggaatttttgacagtgagcatacatgcacttattacttgcataattctgaaaactattttaaaaacaacagaaaatatatgaaagtctattggtgtatacagcattaatagtagtgaaagtttaacagaaaagatctgaaaatctcccaaagttatatagaaacagatctagctgacacactgtgtacctagaaatgattttggatctcttcacagagacccctatcccaccaacctccaatcctcccaccatacattgatccctttctatctgcttggatcattagctgtaaatttaacttcgaaaaacaaagtacgtttaatcattgtac

SEQ ID NO: 2226 - DNA, 358 bp, Homo sapiens
gcttcacaaatgtcaattttattgacactagtgcacaactaaatacaataattgcaaaggaagtggaacgtgtcaaacagaaatggtgacaatgagttagaactgcagttgtttcaaggtactacactattatttaaaaaaaaaaatcacaaaaagaaaaatgttatcactacaagtaggaattagaagagagaaattctggcagtctgtctagaggttaaaacatttcatgcatttgtgagttgctgttggagagttgttttttatttgtccaccgtaatctggcaacatccggggcttaccttcagctctcgcactgtgcgtgagatcgggtgaggcagttataagtgagagcatg

SEQ ID NO: 2227 - DNA, 451 bp, Homo sapiens
ggtttcagttccctttatttttatatggcttacatgtaaatcttttttaaaattcgacttaaaatccaatacaaatgttcttcagtcattagtaaatttcaaagcgaagtcagtaaaagacagaagctggcaactgccttttcatccttcacaagtacaggactatgtcaggggtctgtggccttcatcagcaggtgccctcctttggcgagcggatctgattctgtgtggagaggaggaagtgtcttcttcagtttcagaccctgaaggctcatgatctccctcttgggatcctgtgtctcccaccagttcccggagaaacttgaattttgataaaaaaagatgccatacaaaataccaaccgcacaccatcagcagcaggacgatcagcagcgtggccacgaacacaagcagagtcagcccgacgctgtgccacatcttgggggcagaa

SEQ ID NO: 2228 - DNA, 436 bp, Homo sapiens
aagttttgtctgtttatttaaaaacagaatatcattttatgtacaaatatgcacatatttacataaaatgtacatgttaggatcttagatcttcaggctccacattcgaagtcctaggctggctggggaacgaaggatgggagcctctcccttaggccagaaatccagcagatttcagactaagaagagtttgggtactaaatctaggtattctggctgagtgtatctgggtgggccagctaaaaataaacctcattgaactccagccccaacccagagaaacatccagaagagccttgaattagtgatccaaaacccagggggaaaggcgacattctcacccccagcacctccttcacctcacctcaactcctactctctcggtctataatcactgctctctctctccccaacaccactattgaacaggagccct

SEQ ID NO: 2229 - DNA, 547 bp, Homo sapiens
accttcttaactatgagattattacaaatatatttttacaaatacaaaaaactgaagtacagagaggctaagttaatttctccaaggtcccacagcaagtaactgcagaagggcaaagcaaaaataggacaacacatgtaggcaataccaagcagttcttgtggcagcaactggaaaccttttggagacaccattctgcatttcgttgtagtcatacacaaaaccctagttatgtatccatgcttctttctcataatgccaaagtggcactattctaatttactaacaaggttttctaaaaactacccaaattattgaggtgtttttgctcacttcttcccattagaataaatgtagacaataagaaacgcatgagggatgacatagtcctccatcaaatctgtcctttcacacaagagatggcatggtgtagtgtagcagaatcatgagctgccaggaaattatgaattctgattcctccagctgagtctttgaaaaagtccagatgagaaacacttccatcctgatgctgaagcaaggagaatgt

SEQ ID NO: 2230 - DNA, 441 bp, Homo sapiens
aatcaaaatgcttttattatggtcaaaatcagagccattgagtcctaacagcttaaactagatatagaaagcagggcaagtagtgtaaaacctccacattttctaggcccttcttcatatagcagtttgattatacttcaatttggtgttaagaggacaataatacaaagtaaatgtccacaaaggaccaaaacaccaaattttccatgtccaacaactctctataattaatctactatgtagctagtgtccacgccaaatgttcagttcttaacattcgccaagaaggaatgggaagaaacagatgagtgacttcagatagggagtacactttctcttcctagtctccatcgaacaatctcacttttttaacagagaatcccccacagctacatccaagttaagagcaaaatgcttacacaaaaccaaaagacaaattac

SEQ ID NO: 2231 - DNA, 581 bp, Homo sapiens
cacacatagaatctatttaatgaggctttcccatgtgaacaaattcccttccataataacagtttctctatttcctggctgtgcttggcactacagtcccattcagtccggtaaaacagtggtacgtcttaaatggattttttttttaattctggaaatgaaacacctagtacctgcccttcctcttgtcttttatagtggtttctcccttttgaaataccaaagaacttgtcagtagggaagtaggcagggtgggccagtctgcaagaggcctgtggctgtccctattagcaccagcaggtggcgccactgaggaccgctccgaagcgctctgctcctgggtgctttctctgcggaccagtcctagaactgagggtcccacactgcccgcatcaaccatgtagaggcaccaggacggtcgcgtgtcattaggaagaagtgctgtgtcatccttcacagtacactggggagggttctcctcctgaggcatctggcacagtgcacggctggactcccagcacactgtgaagaggaggaaatgatgcatgtgggggtctccttccaagcccttcgtctctggt

SEQ ID NO: 2232 - DNA, 413 bp, Homo sapiens
aggatcttaaaaaaccatttaataaaaaaaaatctttgaagggacaaatgggaagttttcacttagagtttgatttacaagacaataggaggaatcagatttgggaacacaacaggcttgaacactttctggagactgagagacagttcagagtcagccctcaccgttagccagacccctggccaggacccgcagcaggctggtccagcgggtctgtggggcactcctgtggggcactcttggtggaaacgatgagccaggtgatggtctccccaggagtgggcaatgggtgaggcctgagccctgaactggctggcttttggacagtccttgaaaatgtggctgctccagaagccactcaagctggaccatggtcacagttaacctcaggcccaacattaaacaaaaatgta

SEQ ID NO: 2233 - DNA, 427 bp, Homo sapiens
gagatttcagacagttttattaggagattgttgaaaaggaaaagaaaattaaatacaataacagtaaacgtggttctcacattgaaaccaggctcaaataactaggctaccatagaaaaatttccaattcttgcattatgatgtaaaaacagatttttgtacagattttgtacaacaaaattcgtaataaccttttatcatttttagaaaactttaaatatatagataaaaatagacaattttcataggtcctacatgaagatgagtatgttctgttccaagggcttgcatagagcgcaaatgtggttataatatagaacaactagacattaatatttttaggattacaaaagcatggaaaccataaaatgggcacattttacttgtttatgccaaaacacaaatttccaaaccaacctgtataact

SEQ ID NO: 2234 - DNA, 630 bp, Homo sapiens
gaagacacatgatgtaatattttaatgtaatatttaaaaaaaatcaaattggtatctctggtccacgtcccagctgcctattttgtaaatacagttttattaaaactggggctgggattagggttagacaagccaggtggggtcatccaagtacagggccagacttgtttttattaaaaagtttgatattttatcatggatttcttttctttaccttttctttcttttctttttttttcatgaaccttatttgttcaactattttatttttatttttattttattattttttttttagctcttttgatttgggccaaatctttcctcacctattgactaatctctggcatctcactggatctcaaacctccacctgcctattaaagtccccaccacaggtcctaatttaagctcttgccagacagttccaccttgctgtgaatgcagaaatgagatcaagtcccactcagaagaaaccagaagatgtgaggtaaccagaggggcggctcagcctccagggcagaggagccataatctacctggggccttaccattttccagaaggtccaaagatccctctctgtggcttccttggtagttttcaagggcaaaccttaggcgccatctgct

SEQ ID NO: 2235 - DNA, 543 bp, Homo sapiens
ctctatagcaatactttaatattccaaagaaaaatatgaactgagaattgtattatctagccaaattgtttttactgtgtaaaggctacagataaacatatttgacatggcaaaaatttagggaaattgttccatgagtcttttttaaggaaactattaaatcattaatttcagctgaccaagagattaatgggaatgttttgagtttcaaatacatttaaactgtggaactaagaaatgtgaggatgacaacagaatgtaaatattatatgtcctcacaaggtaggaatgatacaacaaaaattgagagaaaaggaaaagaaagtggaagttcactgatacaataatagttgggcaccagagtgtatcagctaaagctaagctgacaagtcaaagagaagtataatcacatttaacatacaaaagtaggtcaggtgtggtggattatgcttgtaatcccagcactttgggaggctgaggcagatagatctcttgaagccaggagttcaagatcatccaacatggtgaaacctcgcctttact

SEQ ID NO: 2236 - DNA, 484 bp, Homo sapiens
ttaaatgaccccatttgtggggtggtttattgttaaaatgattaaacatgctaaaatcacatggagtggctattccacttttgccctgactccatagtggggcaaatgggaactacaggagtcacttggtttgtgtggcctctggggatggttagacttggagggttagcggtgaacaggttagcaaagccccaagcatccttcatgtagtacacttttcccagcagtaaaaaaattcagagatttcccccttcttcacttttctttcctccctatatgtgccctacttctcattctcctatggccctggaacctcttatgcttctgcccgttatggtcttagactagatgatgagggaggcttttccttgacaccagcattccagtctcccttccttggaactaatctactcagcatgcactattgtggtaagctgcttgatttaggtctgcctagggggaaaacgaggctccagtccccact

SEQ ID NO: 2237 - DNA, 510 bp, Homo sapiens
cctaaaaaaggcttatatttacttgatttgaattttgctagcatgctttttcttctgaattcaagtgactagaactgaaattattccacctggggagaagagacagctgaaagccaatttagtattggttttcaaatacatgaagggtactcagagagaggatgattgccaaagaaaatggtctttgaaccatagaaagaatctgagcttgctctaaagttaaatttcctgacttacagagtttatgacattaaactgagagaccaagggatcctttttggagacttcaaaaataggatagatccttaaatgcctgagatggcttggatgtggctttgtctgaagtcaggaggataaatcttaccactgatggtcccttcaggcgtgtgaatctatgggtttgactggcatgtcagaagctagaatgccagcccaggacatctagagagtcatctctccaatgctgggtagcagtctatcaatcgctctcactgcctcaacatctctcag

SEQ ID NO: 2238 - DNA, 724 bp, Homo sapiens
aaagtgaattgaggtttttaatctttttctgtggcttggaagattgtaattaactttcaaattatctgatctctaaaggttggtgagagctcagctgtgatctggagccatctagagctttcttaatggtagctttttaatcacctctctaatctgtttttttttttggcaattagttaattcaagttttctactttggctcagctttagtattttgctaggaacctatctgttccatccatattttcttggcttttcctggcctgcctggcacagtctgtactgagaggacgaaggccttttccatgagtgtccttggccatgagtgggtcagggcatctccttgttggcttgggtatcagtggggagtggaatgaggacacagcttcacctctaaggactcagaagccttcttgcaaagacaaggccacccctcccttgggggggtttggggggttccaagatgtgaataaacatggagtgttcacaccatcccacggcctgcaaccccagtgagaaggccccagccgcgtttctctttggagtggcccatccatagcattctgcctaaaaaagcagggtcctggagttccagggcttctcactgcacagggcgtgggacacacctcttgtctcttgggaggtacccggagcccagcctctcaggcgctgggcgatgcagggggtggggactgtaagccctgggagatggggcagtgagggg

SEQ ID NO: 2239 - DNA, 466 bp, Homo sapiens
ctttcaatggggtaactttttcatcttctaacctgctctttaatgttttatgacaagcaactgtttcactatcatcagggagtggtatggttttaaatgaggctttctcttccaaatattctaatttatcttgcatttgttcactttcttcctgatcgattgaagaaataaaggccggagcatgaatattcaatatctcacagccttcagaaatgatactaaaggcagtcttctgatcttctgaaagtccggctggcttactagtcactgtaaagtcttcaccttttgcatatgtgtcttcaggttccttgggcatttctttattagaaaccattttatcagcattgcttgctgatgtattagatataaattgagcatagttgctttttgctgaagacagtggttcctttacacgggtatcttccgcagcctccaagtggtgctttgaaacaagaacagattgttt

SEQ ID NO: 2240 - DNA, 488 bp, Homo sapiens
gcaaaataatggaagatccttttgaaacttagtatcttcagttatcaatattactgcattatggagctagtgcaatcctgcatagccttggtcaaaatgacaaggcaaaaaaaaaaaaaattaaagtattatatgaacaagagaagtcattgaagataatttaaggccttgaagtgaattaatcagtctaatttaaagctgaagaataaaccataaattatccacctgaaatgcaagcaatatgctttttcagcttctgttctgtggacaaaataacagaaacaactcttgcttatggtttgtgtattagaatccttctggacctggaggagtgaaagtcaattccatttttcaactgttcatggaagatttcaggactgttttagccgtttgcgtggaatgccaaactgtggacactgtgcagatgctagtgctcgaaaggcttctgctactaaatgagggtgagactgaatcatggacttccaccc

SEQ ID NO: 2241 - DNA, 596 bp, Homo sapiens
gcagaatgtgtcaacaaaaaatactttcttaatggcatttgtgttttaagaaaaatcagtcacatagtgtcagtgttaagaaaaggttgtaggtttacaggttgcccccagtggccatactttgaattgtgattctcacgggtttaaagatgtgatttttaaaaaatcagtgttttaccatctagttatttgatcttgtccacttttttgtgttcaacaaaagtgtaaaactggaaagcaaagaaaaaaagactattttcagtaaacatgtagttttgttttgtctttattgatagaatgtaatgggcctttgggatcttaagtactacttatgttacctttgttattcagatgctgaacttaagcagtgaaataatagaaactaaaggatgttattaaggggtttaactattttaagtcaacatttagcttatccatcatattggtttcctgaagatgtcagaatttttcagtgtaagacaaatatcaaaggtaatagatccagtttaaaaggtgaatccactgtatgtattatattgataccatcattttcaggatctacattaagaggatggtgatacataattagtaatctc

SEQ ID NO: 2242 - DNA, 437 bp, Homo sapiens
ctgcaagcaaaatttattactataccatttatttgatgaattaatcaatgttcaaatggaagaggttttgacaatgtcactatgtttgatgtttatacctgccctgaatgcttgctcagaagagaaacagatttcccagtattttttataacttactttcccattgtcttcaattaatttgctattatcccaagtagacagacaacttcagtagtagccatctccctacatttttagatcactgaaaaaaatggatgagcaacccatgaaaataactagcttactgaaatgcttgtcttttaaagaaagttgggattatttaaaaaaaaaaaaaatggcccaggaccagtagctaggagatctgggagagagaagtcattgccttggttctgacactaagtaacccttttgccttttgcaggtaacttctcatctag

SEQ ID NO: 2243 - DNA, 507 bp, Homo sapiens
aagtcagttgttttattaaaaaataagcactatgcttgggtttcataaaatttatacatgaatatgtacacagacacaaataaaataatattaaaaataaaaatcacacttgctttcaaggcagtggtcctggcaccccacatacataatcaacttttcctttaaagaaattgcttggcccaaggagaccacagttagagaaccactaataaagctgtagcccgttgcctgcaacattttcaattcgggtttcaaaaatatataaataatttaattacaaaacccaacattttttttctcttttggcacagtgaagcatcggtcaatagcaagaaatcactgaagagcctctgacatgtctctcacactcagtcatacctggaaatgccacatacgtacacggatgggggcccagaaaccccaaacagtagtcatatcatttatagtgtggaaaggttccctgatgtacttaggggggagggaagggacataaatcaatggaagtgc

SEQ ID NO: 2244 - DNA, 391 bp, Homo sapiens
gatgttttaaaactttaattatgaaaaagggataaacaattcaagatgggggaaccagccccaaactggctggggcagagagagaccagtccccagccatacaatagcagcaaggggaagaccccaccccacagatgctctgccccagcccttcccagagaccttaaataatttaaatagcagggatggcggagggcaggttgccctggtgtctgcccaatgctaagatgaggggcagcgccggcccagcctcagcctcgggcagggctctggggctgctgcagggctgggaggtatttgagggcagcagccccatggtggcgggacaagtcctggtggaattcgtccttgagggcctggaggcagtcacgataggtggggctggagcgga

SEQ ID NO: 2245 - DNA, 366 bp, Homo sapiens
acagaatacattcatttattgggtcttatcttaaatctccttattagatattcaattcattgtcatccaaaataaaaaaacaaacaacaaaatgcttatgacagaaatcacaaacagatggctaaaatttgaaattgacctcatctctgttctttaggataaatgatacagtagttttttcctctctagcctaaactggcttctgggttttctgataattcactgtactagtacaacatcatggcaatttgtatttccaggattttcattgtcttggttatcatttccaccttcttcgttattctcaggagatacactctcctttttttctgtgggagtagtaactgttttctcaggttgagaatt

SEQ ID NO: 2246 - DNA, 397 bp, Homo sapiens
ggtgtctaatacttttacttcccagcagcataataccactttggtcaggttgaaccactgcacaattttgcagctctttcagaaaaataatgaaaacaattggaaagacatgatgtacatgcaaatggtgagaaaatgatactattgtccaatcctttcccgtaaatgtaaaatatccttagttcatctccaaactgtgtatttattataagcccttacatcagggattttgtttctttcagtttttgtagcaccaaatagacacagcggctaacaagaaataaatctgaaaagtcactgaaatatttatcacatgtcagaaattttctggtctgtacctttaaccatgttcctggcttcacatattcttcttaagagtaagctataacataagatt

SEQ ID NO: 2247 - DNA, 464 bp, Homo sapiens
caagttgacatgtgtatttattgcacaaatatcccctagaactgggaggttattataatacaagtgtacatttgagaaatgtatacagaacaagaaacagctatgtacatatccaacatctaagtaacttagaaaaagcagaacaatctcataagacatctaccagaagtaggcattatgtaaaatctgtttttttaagtgatcatccccagagtatgccaattggaacaaaacaaaatctgtactagtatgtttttattgcacttaacattttcaaactcaaaattaagacatattaataaaagccagaaatatttaaaatcaaaccaattagtttatatacaagaaaaaattagttttaattctataatgtaaaagatcccttttttatttcctgtttcaataaacaggttttttttgatatgtaacaactgtctgtaccataacttgtaaaaattatttag

SEQ ID NO: 2248 - DNA, 516 bp, Homo sapiens
ctgaaaccatcaccataaagatccttccgaagtaaagaaatttggcattatggcctgattaaaatcccattaaatgtacacaggacaaggtctaattatttaaaaggaagccctcccttacctagttccctgtccacctctttatcctcatcattttccacattcttcagccacactgcagttactcaaaagcaccatagtatttcctttctggcttgcttactctactccttctgcctggggtaccattcccaatatgtggcttggtaaatttataagagaaacttttaaagatttaattcaaacatcattttgtttctgtttttttttttttttcctctggcttccaaaactggtcctctctggtagaactgatcactctagttatttggctatattaatcttccttcacaatgcttaaagattcttgggggcaggaaactgtcacacattcatctttgtcttctcagtagtgatgtgcgtaagtttgactttgacatatttgccccaaatctg

SEQ ID NO: 2249 - DNA, 395 bp, Homo sapiens
tgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgc

SEQ ID NO: 2250 - DNA, 478 bp, Homo sapiens
ctttttggaggaagtttattaaattaaaaaaaaaaaactacaaatgagtaattataaaatataatttcactcttttcattatttaccacaaaaatttaaaaataccaatatacagacgagcacaagtgaactggaaaagagctaaaaattgtataaaagacaaatctaaactcaagaatatatgagaagtgacatacaccatacactctcaagtgagttcagaaagcatgttccgtgctgggcaggttttctttccaggtcagtttttattggcactacacctggaaagctctctaagccaaagttcttatgtgtcaggatcttcctagacctcccttggaaagcatttctcataaaacaactcacaccagacaggctgacttattgtaggcacaaaaatcataaatgcctctcataggccccatggagcttggaaaaaaaagatctgctaatgaaagcattacaaaaacagaaaagt

SEQ ID NO: 2251 - DNA, 656 bp, Homo sapiens
cctcaactaaactctttatttttggtttggtttttaagtaggccatggttgctttgaggccactgtatggtggcaaactatagatgaaagagcttttattaaaaaaggcactgatgggagacactggctgcccccgaacctttgccctccctaagagcagcctctcagttcccttttgaggagccccctcacctccaccagatatgggaagacaaatggggtccctgtttctggattcccagcatggtcgggggaagatctgtgacctgggcttggccacgggggctctcagaaggcaaggcctggttggagggtgttggtgggggcagaaagctgagcagattctgggagcagcccaccccatatcctagtaactcccttttgctcttccagacttattatgcggcttggaccattgatgcctgtgctcccaggagatacagcatcaaatggcgtggagaaaggacctgtcttaggatgtgttcccatgttgcttcaccttcttagggagccgccgcagtgacgtgcgcctggcctctcccttgatcagacccgaggctcctgggtagacctcctcttctcacttgcagttaaggaagccgaggccccatgggattaggtgtacgtccaagatctccaagtactagaggagtctg

SEQ ID NO: 2252 - DNA, 442 bp, Homo sapiens
gagtactaaagtcctttattcaacaacacagaaatttcacaaaaacaactttactgggcaaattgaatgtgattttttttactttttttttttttttacagttttgtacatgccccataagtaattttctttaataaatacactgttttccaaaaccgttttttaaataattgcacaagcatacatacaccttacacaaatatctattagaaaatttaatagataactgcacagttcagaagaggagaacactgtgaaaggagtacattttgtggcccatgttcctgaaatatctgttttgcaattgtgaaaatggaatccctcctaatatagtagctgtcttttattcactaggaatacagatctcagtgtgaaatgccaaatttaataaaaaaaaaaaaactgaaacatttagctgttacatgagaaccaactgtttgat

SEQ ID NO: 2253 - DNA, 434 bp, Homo sapiens
ggatttcataaaatgattttaatagaaaagtacaagatatgaacaaaaataaataatctttatctcatttctagcccagcaaattgtacactgcatataaaaatggtctaagatgcaattttcctccattccttttttgcttttaaaatactgagacagcattttaattcaatattctaggttcaaactgatacattaaaaaaaaatcataccaacctttaatcattctacatccattttttaaagttagctaacaagatgatgtttcactaaaataaaatatccaatcatcagattaaagtgtaaagtttgtgtgaacagggaaattagatcatttctctaagttttaattcctatgtttctgaatgtttcttgaattaaaaattcatttcatcatcttactttcaaaacacggcatctctctttcaccattc

SEQ ID NO: 2254 - DNA, 441 bp, Homo sapiens
agtagatatccgaccaaacgttttattggggttttattgcaatctactttcagcaataaggggaaagtgagcatgaaaagaactccaatcagactttattcaataaagcagcttttcatgaatgcttcaggtcagtgtatgatcagctcagcttccagtatcaacttgagtacctcattatggatatttatgctagaatgacaacagtaaggcattgcaaaatccaaagtcatctaatattaaaccatattttacataatttgtaggacagtatactaatactctacaataaataaggatttaaaaatgtgttgcttagcccttgaactaaattcaattactagcttattctaagtactccagttaataaacgtttgattgtaaagaactctgacttctccaaagataaaaaaaattagttgtcatgacaaaaattaagct

SEQ ID NO: 2255 - DNA, 383 bp, Homo sapiens
cccattgtatttgctttcttctggttttcatcagccttttaagggcacagatattttaatttaaagggtgatttggatatgcttttttgttaactgagattcatgccacagtcagatactggtgatagaaaagcccaaaaaggcttgtagaaaagaggcaagcagcaatccaccaggtcagaaaagacagaagtcctcgaaaaagaagaggagtaaaaatattttttaagctgctcagtgccactgttatttgtgtaacagttaccttcattttcccttcagctgatggtaattcagagtaaacagaattggacagtagactattatccactggtaaggtagagatagattctggataaataccccaggaatgattacctaga

SEQ ID NO: 2256 - DNA, 481 bp, Homo sapiens
caaatccatttggaacacatttattcttgggatagtttggacaatcacaaggcaattctaaggaagactcccacgacactgcctaagaccaagatttgggaaaattgattccactgatcactgaaaaatttcttgcccagtaactgtcggtggactttatccaagaactgggggttcaattagtaggccaaactccacacctcttacagtaagatacataaaagataaattaggtcccctaggcgcaaggtcaggtgacacttcggtgactgcagaaggggcgattcctagagatatgcttcaaagcaagtgggacttagagataagcagagccgagaggtggatacggctgctcgagagggatctacccacaagataagccacctcccgccagcccccaaggtttgctattcgacaccgttacccagcagctccgccacacacaggcggacgggagctggatacctaagcaaaaaacgct

SEQ ID NO: 2257 - DNA, 503 bp, Homo sapiens
attgtagactagtctgtttttatttacaatttaagatataaattagtaaagaattcgtgttaaacaaccaacaaagattgtataaccagcaatgttcaaataaaaaccaggcagaatttatttacaaaaagtttagattccattgcaatacaacttgcataaattactagaagctttatatcattataaaaataaatatcaaatttgtttccacttctgaagtactcaagttcttccatcacgttttatttctactgtgtacatcttttacaaataaactttacagtaaatcctatcacacctatagaatatataccgtggcaatgaagtgatcaattcaagatatcctgagaaaaacagattgttttcaaaagtcacacatacatcggggaaactatactatgccaacaaattcacatatgtccaacaatagtctgttccaattgttagagtctgtgggctgacagtgctgtgtggatccttctcttttacagtggcacaag

SEQ ID NO: 2258 - DNA, 379 bp, Homo sapiens
taaattttacacatttttatttttaataataggagtaaataccttcccacaacaatataatgaacattacaggaaaattaaggcaacttattatttacagaatgcctttctgtgcaaaacaggacactatactcttcctacacattaaagcattaaagattaaaataactctaaaaggtacttattatcagtgtctttactgaggcaattaccagtgttcagataaataaatgtcagagctaatccaaatatgaaacttgaaattttcccaccattctatacaaattcccacagcaaacagaggaggttattattttagataagtcagggaaagactttgcagaggaagtaacatttctgagatggagaaaactaggag

SEQ ID NO: 2259 - DNA, 698 bp, Homo sapiens
gagtgaaatattttattgaaaatagttaatttaaaatatatacatcatttttcaaaagccatgtgactgataaaaatatcaaactttccatacaagcatcatctcagcttcatcccctcggcaaagtgtctcccgaatctttccagatggacatttcgtttgagtctctagcgccctctggtgaaacaccatgaaattgcccaaaaacgtaattcaggctctgctcaggacggaaggtgaaatagcagaatgagcgcctatttcaatgtgacaggttgtgatgtgctgccttctccccgagctcaggagaaaggcagcctctgtgagtgcttctctctctttagggaaagtattcttcccatggacactcagccaagcttattgcaaaataccttcttcctaagttttcatcatcactgccttctgaaaaaacaaaaaccggtcaatacagacaggataaataatgaaagcctccaagtcattcaggaccaggcccctactcctcgcaaatgttagaaggacagcaaaaatgataaagcaagctgagtatgcaagaaaagctttcctagtggtccccgattcttcaagctgtctttacaataatgaataccaccactctagtcaactcaggtttacattttctggcagcagatgaccttgtcctcaggtttcaagaagcacacctcttctaaatgggg

SEQ ID NO: 2260 - DNA, 556 bp, Homo sapiens
cttgttttatcatgtaattttcagaaaatatgtgatccataaagattaaaagaaagttgtattaagtctggcagctttagtattaacttgaaataaaatatggcaagctttccacgtcctcctttatttccacaatccatatgtacgagctagattccagtcagaacttccacaaatacttcactctttggtagcagcggttataaattacgcctttgctaatttgcgttgttcccaaccaggagaaacattaccacaaaaaaagtcagtttcatcctgcagtgttcccgcagcaaccatattaagctggaagaataaagctcctttgtagtagtagcgtctattgaattacaatgtaaatgttgatgcctcccctggaaacgtcaaatgacaacaggtttacagaacgaattcagtggttgtttgcagctctggaatcccaggctgcagagttgagatcgaagaggtgcgtctggccatcttagcgttcattcaaccaaatctcctcactccatcaaaaccacgccactccccacctgcccagctcgtaaaagga

SEQ ID NO: 2261 - DNA, 514 bp, Homo sapiens
caaaatctgaaacagaattcattatttcccacagatgaaaataacagaactgtgattgagaaatggagcttaacctgtactaaaaagaatggcttacaacaggggtccccaaccagatataagccataatcacagatatgcttatttgcacagtagctgttgccgaatttcagtctaccatgtgcctattattcaccaaaatagtaatcatacctataccttttaagtattacctataaattcttgctccttatgaaatctcttaatcttccctgattttttattgctattgttgtttgtttttacaaaatctccttaccaaactttggggcacaaaggcctttcaggttgaaaaatttaaactgtccaatcaagtattggccaatattaatgttgtaaacctgtaggtctccttgtatctattctcaatattctccatagcaatttttctcactagtgccttgctcttttctttctcctgcctctatgcaaagccacaattttaccaatttct

SEQ ID NO: 2262 - DNA, 499 bp, Homo sapiens
caattgtcacaaagcaataatcatttattttttaaagtcgtttacaggtatttataggcaaatggatttccactttaagacagataaagaatgtgagattaaaatagcatgcagacattccttttattgtttccttttgctttaactgtgtctgtggtatttttaagtgctgtatttaactactatactattacagtcaaatactgattatccatgtgtactgctgacaccatttacagtcattgcatctatttgtatcaggaactcttgctaccaagttaatactctgctcagctagagtgagaccacagccctgctctgtctctgataaaagtggttagactacccatacatttctactgtctatactcatgctgatcccctttttaaggacaaacgatcaagacctaaggtatatggaaaactggtgaaaaatacattaattctagttgtgtaaggggaaacaaatccatctaaaaaattaatggcagtagaaata

SEQ ID NO: 2263 - DNA, 450 bp, Homo sapiens
tttttttttagctttattgactattaccaactttcagtatggttcaaataattaaatactgcaactgggacattaaaaatacaagctaatttaccaaaataattgtattctgaatattatgtacaatattatacattttacattacataatgggtttttatacataaaggtaagatttctgattattggaaatacaaagtacaactgaacaaaacattcctatgcgtacatacacaatcactcaactggaacaatcaaaaccatctatgagtgtggttattaaaaaataaaattacgttcatacaatggtagaaaatgaaatgtttttattaatttgattattaatacaaaaccacacatatatgaattatataacctagtgttatatatttaaaaatctttatgcttgcaactgaaatgtctctactccaagggaagtttctgattttt

SEQ ID NO: 2264 - DNA, 482 bp, Homo sapiens
gcttattccagaagcaggtgtctttttcttgatagtgctagcccaaatgataagactatctctgattaacttcagttttgttaatctgcccattcctgaactaatcactatggctgaatgataggatactttggctagcctgatttgtgggcctactcctgtggtataaaaattagaattaggtaatgaacgattgcatctggagaaagagggacaggtctttattagggcacgctctgaaatctcagtggcctaacacaaaagaatgcgtatgagctgtagcacaagtgtccctaattggcaagcaagtatcctcccagtgaagagtcaggaaactctagcacaagtgtctctaattgggaagcaagtatcctccaagtgaagattcaggaaaccaggagtcctatcttgcggctttgccatctttaacacatagtttccagtgcaaatttgctcatctgcctcaagttgatggggagtgg

SEQ ID NO: 2265 - DNA, 370 bp, Homo sapiens
accacttaaatgtattttattaagtagctcaaactcattatgagtactatttcttaagacatttaaggtagtatacatttttgctaaatggtgaaaaacaaattaactaatcatctaaatggcctccagattccatgtgtcctctttttcatgctttcactattgtcttccccaaattatctcctttcagcattcccataaatgcagctggcatgttttcaaatccttcaatgatatattccttgtactggattttaccctgatacaagtttttcgctaatgtattccagtgatggcttagcactcttcatggatttatagacaagattatttgcttgaagtcagtcaattacaaagtagggaagctcta

SEQ ID NO: 2266 - DNA, 495 bp, Homo sapiens
gacataagaacagttttattttaatcacttaagacttgtgcattattcaattttgagactgaaatacttgtttccctttcaactgattaggaaatggtctgagctggcagaagttaatcctcacattattcagctaatgagagacagaatcctaaaacctgattccaacttccgcctgtacctcacaatgcaagacaaagcctttcattttaatgttgtacacatataaggaccatataatctggattaactttaggtaacaataacttaaaagataggaaaatgtatcatattacagagatttaaaaattgtctatacaataaatgatgaagaaaactaacaacaaacaggacgacgttcaaatactgaatacaattaacaaatggggccaaaagatcaacatttatctctcatcatctttcatgcaatgtctcagctttcttctcccaaacataaaggcagattaattcaaagtagccctattaagaatattt

SEQ ID NO: 2267 - DNA, 459 bp, Homo sapiens
ccttcaaatgttataatttatttcagcttcagaaatacagcttcacattttcacaataggtacatgtgaccttcaagaacgatacaggctttgagatttttcttcaaaaattccattctaagagtccatatatcagcattaagaaatcctgaaagtgccaagaagacagtggaaagtatccggctcatattaattaaagaatcagcagagaagacaagattttacttctgtatattccttcttcaaacaaagcaaaagaaaaatttgacccaaaaaagggaaagtaaaaatagacaagcaagcaaaacaaaggctgtacatgtacataggaaatataacacaaatcaagtagtactggtggaattactggttggggggaataatttttaacaaactggtagcagacaaggcaagtggttagacagagtaatttttgtcataattttaaaacatttcata

SEQ ID NO: 2268 - DNA, 484 bp, Homo sapiens
gaaaaagaacacatatagtttaattgatactttgccaatacaaaaataagcatccacagaatgtttatttactgtttaaattactccatattttcatatactgtgaacagaaaatatattttaccccacatatagtaaaagcaaacaagtgcaatctttcaaacattaaaatcataatcaaatctgtacaacagataaataaatgtatacctctaacagttagcttgtaaaaaaaaatcaaacaaaaagcaaaaacatttattgcccaaattcaccagtttacttaaaattctacttatggtaatacagctcaatcgtaacaacttgcatgtttactacactgcacaagtttagactgataaatatttaaaataggaggtgggtaataggaaataccaaatggctataaagagctttccaaatattggaaataatatacgaaaattaattagtggggatacctattaaatggatccacagggta

SEQ ID NO: 2269 - DNA, 633 bp, Homo sapiens
gaaaagcagaaatggaagtcaaagtgtgttataaattgagactgaaaaacatgctttaaaaaatagatttaatttcttacactgtgaatagccattgtattgttttgtttctgataaatcagttgttttgggcccctatttttgaactgttaaaaaattttgatgcttttcgtggataaaagtagtgcctctctttatacaactgatggggttttaaaaagtgtaaattgccttttttgttaaacttattttaaatgctttagtatttaaagggtgtatgttattaattaatctgcatatttgtaacgcaaataactacttcctgatttacatctcaatatattcttctttcatttgcccaatttaaaaaatacgtagtctctattgttgctgtttactaatagttttagatcccaatgtgtattagaattatagctacaaaaagttgcaagtaaaatttagcaatttcctattcaaacaggatctcattagtatgttttttaatgtgtagaattaacactttaaaataaacaggtgtgaaaattataaaggaatatatatgacaattattttctgtacattaatgtctaaacattatacttactttttcataataaaggaaattttggaacc

SEQ ID NO: 2270 - DNA, 453 bp, Homo sapiens
gcttaaaacaagcacatatatttttatgtacctatattacaaacacattaaaaaatgtctgcaagatgtatatgttttcctttacacagggtactggaattggaagtggagataatgaaaggaccctttactttcaactgtaatattttatttaaatgtaaatgtattcatgatttagcctagattaaaaaaaaaatcagctagctagaagaatgaggtaacttttaattttagtactaaaggataaacagtatttcacccaacagatgaggggggaaaatatgaattagaggacatgccaattacttagagataagaggaagtcaagactttctgaaaaccaaacttccaaattttgcctataccgccaggttagttcaacacaattcaacccaaattactaagtacctaatgtgtaaaaagaattgcactaggtgttgaggatagatcctg

SEQ ID NO: 2271 - DNA, 578 bp, Homo sapiens
cctttgacagtgaccatttattacacacatcagactgggggaagaccattgacatagctgagcaccaggtagggtgtcctgggtattcgggcatgagagcagcaggggcctcctgacgcgggcaggagaaacatggcacccaccaggaggaggaagaggaggaagaggataaggaggaaggtcagaggctgcctggatgcaggatcgggggcccctggattcccctccagcctcacatcctggagatgaggagatgcttgcctcttcttgtcctgaggcttccggagcagggagtgtctttggtgacgtgctaagcgtttctggtggccgaggccagactccagcatgtcctgtcgggagtgagaggtgtctgcttcctcaaggccttgtcccctgccctggggccccctgtggccacacagctcacagggcactcctagtgtccgggctgtcttttgtcccaagggcccaaggcccccaatgtcccccgccggatcccactccaactctgtggaagtggggaggctactgggtgcccagggcccccagaccccaccaggtcctggccagtccgagtc

SEQ ID NO: 2272 - DNA, 402 bp, Homo sapiens
atttggaagcaaaatttttattttttaagaacagagctatttcataaagccagctacaacatctgtggtacaaactcatcccagctctctcgccatattccctctctgtagacccagagaccatatccataacccaaagggacacagggagggcagacagaccttctttaggagagaagtttagaaactgatccacttcatgaggctccagcttaattttaggaataatggtctggcacgaggaatcaaccccagtgttcatttccagaggaggttcctccttttccaacggggtggagatggctgtgatggtcagagtgacagacggaacgagtcctgggggtggttcgtctgtaactggctctgtcttgatggatgttgaagggaagtctgtagacaggt

SEQ ID NO: 2273 - DNA, 607 bp, Homo sapiens
accatccagtcaagtttattaaaaaaatacagacacacaaacttaagaaactggaaggaacaaaatgttcatgatagcttttttgtgagatggtaggattccagataaatgcttttcattttctcccttgtgcatctttgtgttctccatattttccataatcaattatgtttacgatcaggagagagtgctgagagaagaacagagctggcgtgaatgccctgggggataagggctgatggcaggagctcatccttgcagcactggtgacagtggctgttgggcaggacctgaagctacgtgcacagtcgtccccgttgcagggtgggagaccaaaaccccaggaggacatccaggccactcagtgagggatggatctgaaccttgtcatcgtcctcgcaggtcatgacattggagaaggggatctcggccttgaacattttccggcagtgcatgagctgcaccagcaggtagcagacagtcttgaacttcatccttttggccggttttatatctgagagaatcaggcctggaaatatctttcggcgatgggatggcacaataaaaaaggtttcgatgttatgagttttcaagaaactgttcctct

SEQ ID NO: 2274 - DNA, 462 bp, Homo sapiens
gaatgtaacaagcatttattaaaaactgtgctgcacaaaacatgttagaaactagccaggtgctaggagtctaatcaaggcaggggcagggtaaaaacatgggaatattacatggacaagcttgtctagcatggcagtctataacccttgagggtttacataaaataaaggaacatttttgtggctcaggctccccagagttctctttatgtttgggcagagactgccccatcccttagtgatcccaccttagagccaggttttcaaagtcatttctcccagtatatctgtctctgtatgcaagtttcctctggttgccttgagcaaaaacaatcatccaactcaaatttgctagccctatgctgggccagcccacgttcccgtaggacatctgtaggctaagtaagccccgggtgatctgtgtcttggtcttcctaattccgttgcagctcttcctctctc

SEQ ID NO: 2275 - DNA, 493 bp, Homo sapiens
caggtttaaaatacttacagctttattaggagaaggctgtggtcacctcagcagccagctcccttgtatacacagtatacacagcccagccagcacccaggtccttccatccttctgcagtacatggagtgcaaaagaaccaaacacaacggcggggagggagggtctaccaatgagtgtcagtgtctagtgcttccgggagccaactgccaggctagggacactcaagtccctcaaactgtcatcagctcctgccagaccccactccagcatgtcgagtgtttgggccagactcctccaatcagtgcacgcgatgggcagaggaggctagggaatcctgagcccaaagctgtattggtccatccccctcaagaagttgttggagctttcagaacgttcctcttcttgtgtagacatgagataccgctgtaactttactccatcaccagaaacctgtgccttgagtctagtctctgctcagccctcgagagca

SEQ ID NO: 2276 - DNA, 552 bp, Homo sapiens
gcactgattctgcagaagctttatttattggtggattcagattcagcgtcccgactcagttactccagtaccatcagccaccaccacacagatggcctcagctcggatggccccataccccaccctagcgacccacgggtgagtttgctgagtatgtgagattaactggtggctcagtggtcggctcctctagtggataattccattcaaagccaatgctcttgatgccaaggagttgatactggccatagatgcccaccagcacctgcccctcttggctggggtaggcagaggagatctggccatcaagcttcccaaaatagaaatagcggtccttgctggtgtacatgaccataccccggaggaaagcttggaaggcgacaaagacttttgtgatgtattcgcctggctgcagggtgacttcctgggtattcccacctaaggctcccagtttcacgtcccaggagtctccaagtttcacctggacacttttcaccaggagaagacctacagacacccgcagccctgtgatttcatggtcgtagtcttcag

SEQ ID NO: 2277 - DNA, 654 bp, Homo sapiens
acactaactccgggtagttagtgtcacaattgaattgtagatactcaattggtgtccggaagaatcagagaattggttgatggtgttggaaaacaccctaccaatataacacttaagttcatttttagcataatatctgactgggttttcagatgttttaatattagagaagaaatggtggtgtaagagacaaagaaataacaattatgcataaaagaattttatttagtggccagatcccaatgaataatgtcagtcattgcttggttctgctaaaatgtggtattagatatattcttaagaaagtgtacaattgcatcaccaaaagctgtttaatttggattgtgtagaataaaagaaaactacataagtctttgttctttgataaaaattttaaaatataaaaatgaaaaaaagaaacccaaaagcagtattcaaaactaacaaatgtcaccttggactatttacagtaagacgcctttttgacaggagaatcttgttctcagcttgttcttttcctcacattttacttacagggattctcactcccccatctgatccctattcataacttcttccattcctgtctcacatgaaacagccatcttccatgctctctcactcatctttgagtctctctctgacactcctttt

SEQ ID NO: 2278 - DNA, 585 bp, Homo sapiens
agatccattgacttttattacaaatgtacttgatcacttggcttcaaaaagtttaaaatcaataccctattttctgtatgccagtacaaagcaaactgttttacaaattaaatacctaaaaatttgacaaaaatattaaaatttgatgaaaaacaattataaaaatccttaatctctctcttcaaaaaaggaggcagtcttcccactcctattatacaatattaataatattcaccatttttagaataggtagctaaattatatctttctgttagcatacaaaacttagactaatatatttgtatatgctccagttaagtttgtgaatgccatctgattgcaatataatcaactatctttaattgaatcctaatttacacttatttaataatttgcatagtttgaaagggataaaggttattctacaactaattatcataggctattacagtgctacttttcaaggcaataagtatttgctcccaaatgaagtatatgtcttctttaggcaggggttaaaattactagcagctttctctattacctgaaaaatcaaattggaagttatccatctctctagatgtg

SEQ ID NO: 2279 - DNA, 364 bp, Homo sapiens
gttgagaagtgtttattgtaaaaatggagtttataatgaaaataaaaaattatttcataacattctgataccactacacctgagttcgatgccagcatggtttgaaagtgaagctgatacaagttttctaaaggatgttaaaaaactatagtatgaagaatgtaataatattttagaagacattaaaacttaaatatttagatgctgtatatgagaaatcacaccaagctctcttaattaggttaacattagacaactacatctcaatttccaagcttccaaaaataggtaaaaaaattattttagtttaagttgatattaaaaacacattgggagcaggaatccattctttcaggttttaaga

SEQ ID NO: 2280 - DNA, 582 bp, Homo sapiens
tcttctgagctgtttacaactgaccactgtgttccacagatgtatttttcaatagctttttgttacttagttttccatgatgcctgttatttttctcttgtaaatttaaatgagctgactttaaggatcttgggaaaacccatggcataattacaattttctttttaatcgacttttcattacttttgggagtctgttggtaactaaagatgtcaacaaagaataaattggagaagttacctgtccccactatagcagtaaacaaaacagatgaaaaacaccttgctgttaactcaatggttgatctaattgtgaaatcgttcaccttgttaaacatctaagtaagtctgtagtcgctctgcaaacagccattatatttatttactctagaagaaactgtagagtagtaattcgtgctaatgagaaaaacaaaataccatgttcaaaacagatgtatttgaaaacttaatgacatggttccaaaaactagagcatgtatgtatgctgtgcatcatctcagcagacctaaaatatccccaagttgtccctttacagccatcaatatattttaaactctgcggc

SEQ ID NO: 2281 - DNA, 612 bp, Homo sapiens
aagtagcataatgacctttattaatcactgcatctggtgtttgccaaatgggagagaaacaatactcaagcagccttttgttaaggggtaacaagttatctgaatgaagatacttcagcacatttaaattatatttaaattatatcaagatagtgctataaacatttaatttcaagtagcattctcaataaaataactcattgcaaacctaattgctctctagagaagattactgggcagtctgtttcagtaataacataaagcaagaatcgaatcctctcagtaattaggtaacagattaaatttatcaattatctactatctgttatctcacttagatgataagccatagagaaacaaataccaggcaagctcatgaaccaccgaattcttcagaattattcacttttctccaaaatgattaatgaattgcagtccttgccctcaagaagctcacagcttaataaagggtacgaccctctagaaaataatcatatacacatacgctgtaagataataagtaaagacatattcaaagagctactctaaagcatttccaggtggaacttagtacctctgctctaccagttcccagctatcccctatgataca

SEQ ID NO: 2282 - DNA, 415 bp, Homo sapiens
atcctactgcatgaactgacaaatttctggcattcatacatatttaaacatttagtgctaatatttgtacagaaaaaagttaataatactaaaacatatgttactatgatttcacttttagcctacatcatatactaatttccccttttacatgcagctttaatattgtccaaacaatggcacaaataaagaaacaaagtcaaccatctattccccactgcccaccaccccatccccacatcaaaccgttcaggactctcttccccagccgggctggagtggccctcgggctgctcagtgagacccggacccaaggccactggagcgagggagctgattcctcctcctctggggcacaccttcctgtaaacgtggctggggcaacacggccccagagccaagggaagctgctctc

SEQ ID NO: 2283 - DNA, 368 bp, Homo sapiens
gcttaacacatttccatttattatttttaataaagagtttaagatcccattttttaaaaagtacaatacagttgattttttaaaatgaggttctacaaacacttttggacagtctaacatacatataagctgtccctttcaactaggatatggggaaaagaagtcaacccagtgtttccactttccatgaaggacttctcaagggcaaggtaataagcaggaataaagcttccaaaaacctggaaggactctttcaggtggactaataagcatcatcatcacctgccttaaactacagtaaagccaagattgttaataatatagttccttgcttttagctagtatagaaaataaaattgaatcacatt

SEQ ID NO: 2284 - DNA, 509 bp, Homo sapiens
agacaaactaactgaagccacagccggaagcaggctgaccacaagtgctaaggttctggttagttcttttctaggttcaaaagaagaggctgttctaagaaagactaccgagtaatcaatcacctcctcagagaaagtctgctcaggaaactctcctcccaccagcccctgcacttggttccttgcgttgcctctggctggaagctgttgtccccaacttcagaaagtgtctgcagatttcacaggctctctcttgggtcaaggattgatcaaataaatatatcacggataatgggagctggattcctcactgcctgagaaaagaacacaaatagagaaagggagaaagaataaaccctgtaatgctgaaatggaattaaagggaccagctctgtgaacacggcaagtaacaacagagagaaaacgtgaggagaaaagagagaccgggattttgaaatcctgtttcctgaatgccatctcaccaggcacacgaaagaataaaattaagg

SEQ ID NO: 2285 - DNA, 755 bp, Homo sapiens
agaacagtggatctctcttccactttaggaaaatgttatctgtctagaaaaatggccatttttggtagcaaaacttaaatgtgtaactgtgaaaaatgcacgtttaaattagtagaaaaaaaaataacaatgcaattctccttggctagaatgtttttgttcctccttgaaattttaaatcaacacaacgtagcaaccctccctgcccacctcagaaaaggtcacactgtatgcactgtatgaaccttgtcaaaattctacgtattattcaaaaaagttttcatgccaggatattctccaaattcttttttcatttttttttctggagagtgctctattctaggatttaattacacttcaaacgtaattgaaatttacctaccctgcttgtccaaacaatcaagagccacttccataaaatctaaactactttagatataaaccatttttaccaaaagtcacatcatagtcacaactgcaaactggcattgctatgcaaggctggcagtaaacattaacattagcttgcaaaattaatacaggcctacagtctgataactcttctagacccagcctgattcttatcaggctatggatgaagaagtttaattaaaactcaatccagtctagactgtgtgacctgttctttgtgctattactgttcagtggcatcaaatgcatcataattataggtggaaaggctagtaatgatgccagcaacttgtttaaatgaagtttttataatttttaaagct

SEQ ID NO: 2286 - DNA, 453 bp, Homo sapiens
ttggttataatagctatttattaccataatgagaaatgaacaaaagttttacagtgagatgacaaagttcaaatattatctgtagtatacaagaactagataaaaaaaaaaaaacacatggtgcaaaaagggtgcctactatttaaataccctatacctgagttacaaatcacctaagcacaattacaaataattcagcctagcacccatgcaggacactggctagtacatgggtagccagcagagcctcttagcagaggcaaaatcaattgcatttcaaggaaatagtctcccagcatcagaatgcagagatggatgctttcctcccctcacttggtccctaattgttctctttacaacactagcagatgttggggctcagaaaacccaaagtgaaggcctcagaagcaaagtttttctctgatgttatcctgccctcctgtctcagcctca

SEQ ID NO: 2287 - DNA, 661 bp, Homo sapiens
gacagcagaagtctttttattcaaatctcccaccttacagatgtccagaataatcaacatatttcaaagggtatatttcaaaaacgtactagcaactcagccagccactgtcacatggaataagaagacatgccctggccattagaaccatgctgtcctcgctcttgtgtccctccacgggacagacatcaccttgcaagacaactcgtgccactgtccccaacagttttccacagagttcttgtttcccttcatctgaatcttctctgtgcaatttgatgtcctgaactatttctgacggttgcacacaagatctcagggactggaccttttagttatgagaccagccctcttagacagcagacagtaggtacagtgcttgctctcccttctttgcatccttccagagttgccttcatcctcatttcctgcatctggtaaagtctctctgaaaatgtgaaaccgacgacagaacatggcaagctggatggagaagccgacaacccctcccccactctcacccaacgccgggccggtcctgtttcggatcctgcacactgtggaagcttcttgcttccttgttttggtgggtgaaatctttgctgttcaaaaaggtgtttttgcacagaaattttaggacgtgtttattctagtaacgtag

SEQ ID NO: 2288 - DNA, 557 bp, Homo sapiens
aaatgtgctaagataaataactttgtatatttgtaatttttaaaaattttaatttccaattttgccaagttcagaaatacatacaacttaaagcaaatagggtacaatgttaacaccaggtgagggttacatggtgttcactctactgttttacttttgctgtagatttgcaatttttcaaaataaaaaatgaaaaaatgtttataagacaaagtctatgtcactgagtatcactagttttagagttaaaaggtgccctgtcttataggtaaaaacttttctgctaagagaagcatgggagaaatatttgacatgcattaaaggacaaaactggtttagaagccaataaagagagaacacactgcatgtaccaccctcatcatctcgagttttcaaaacaagcatgttcctcttgctccaacagactcccatgctaatcatgcaaaaacacagcaatccaccaacttccacatttacaaatgatgataaaagtttaaaaacatatctctcaataagatgaaaatgttttctgactttgacaaataaagttttctcag

SEQ ID NO: 2289 - DNA, 486 bp, Homo sapiens
tttgacatattaatcctttattagaaattgtaaatgagaaattatatcaacacctgaggaccaaactacaacagaatattccataggctcaagattttgagacattctggaaagagttttctgtaaggtatatcctttccgtggcatggcaacatcatcattctttaaaaaggtgactggacagacatcatttccaccatcaccaatataaacaatttgtgtataattcactccctgttgtaactgtttatctacaaattctatcaaaactacctttttgcaaagattctttgggcatctattgcaagaatgagtatgataattttcaacagtgagatgaccattgctattaaaagctgctggatttgtaaacactttatcaaatatgtcatgaaaactggcagcttctaaaacccaatctatgaagaccgaatttgaatctgaaataataatgcagtcaaatttatccttattctttcttataaa

SEQ ID NO: 2290 - DNA, 467 bp, Homo sapiens
ccaataacttaatagtttattagtcagtcaacaatattacaaatatttaaaaattacttaatataaatagttggcagcaaactattccattacagagttaaattaccagtacaacagacagactggagatttagacacctggaagataacaataaaataaactaaaatatttaacgaaaaatttaagctgaaggtgtttacctagtgtccataaaagcatgggttctctttttatttagaaaaaaataaaaaacggctttaacaccccattaggaatataaaataaaatcaactgaaaatattaatttgcatatcaaagaaccatttataattacaatccaaacactccataaaccacttgtgcgattctatacagaaactgggaattagaaactagttgctttaatattacaaagatttcagctccaaaaataattcaacataaaataaactttagcaattagtgt

SEQ ID NO: 2291 - DNA, 487 bp, Homo sapiens
gccatgaattcctttttactgaaataccgtaggactcactaccacaataagtacttaagctgaaagagtttctaatgggagccaagtaaattcagctctccactgtgcaaagcatcttgtcatttctataataaaagtctttccatgttcagtccactttggctctggaacctggatgagtcatgcttggggcccagggtgcctgtgaggatgctgcatgagaatttcagctgtggtggcagtggctgggagtcccactgactcagggggaggccaggcgagatgagctggaacttttaggggagagctggcacttagggacatcattgattgtgcttttcttagcctagttctgtcctgcaatttatttttcttatcatgtgactgtcggctgaagtctggggtcatttggtttctttttcttcttccttgctggacagtctccatggggtcacggttgtctaggtaattaaaacgaatgatatct

SEQ ID NO: 2292 - DNA, 676 bp, Homo sapiens
atgtaattgcctgtttatttagtggcaccagttttccaaactagaaattatttctacttttcatctaacatacaatctgcaaccattcgcaggctgaatgcaatttttcaatgaacttgaaaacaaacagtacattcttaaagttagaactgaattcacatattttctttggaccaggaaataatacataatacaaaatatacatttatggaatttctttaaaagtgtggatcacataaactgcaaagtgggtgagttgctacggagaattttgttacacattgtatttaagaaaaatatttctgcaattatattattcttaacatttatagagtttaaaaaatgaatatataatgcaacatgcttttaacatgtacatgtctctccactcataacatttatacaaattaagtgatataactcatttcaagagtgaaatcaatcactattggggcatatcactacaaacaagatattttcctgcagatatgctatttagtcaagggataaccaggtaagataatggtttctatgttccagaagtcccacaaatgggaactaaataagctgtcattaaacatctaattttggcaacaaatgcaaaattctatacgtttgttacattgtacttatcatattttagaaatctcattaactgtgtgcattggtggtggtt

SEQ ID NO: 2293 - DNA, 370 bp, Homo sapiens
gattgggtaaaatatatacaagataatgctatacttttaaaagagaaaaagcactttacattgtttaggtctttggatctgcatatgtccctgaggtaagtattccagccatgggaaactgaagcacagagaggtagtcacccaccaaagctcagggctggcctccagagcttgaacccttgcctgagctggggtcaccagcctgggtgggccacggagcgatcatcatttctccatctgatcggaaagtcacccaccactctgttctggggcccagcccgcctggctccaggcaggctcggaggccgtgctctcctggacctggtgcatctggctgcagccagcactgggcaggaaaataccgctggag

SEQ ID NO: 2294 - DNA, 472 bp, Homo sapiens
aacttccttcctataaacaccttcagtcaaagaaagccagaggagatgcactgagactgaaataacatctgttgactaccagacttcactgaaatcggccgtctgctctcctgagttggcattgttgctaagataaagcaaatgaaattgaagctgtactcttgatatttacaccatacaagactaggctgttagggttgtcctgtgtggtctgcagccagaggttacactgtaactaccatatgcaggccagacattcattctgtgcttagggactgaattacactataaggtgtaacactggaccgaagacttttccattaaaaaaaagtgctgcttttctaattctttatattttccaatactcattcctaaaatgtcatgaaatggtacctaaaagcaaagtactggaagataatcacatcatgtcacatttggtcttaatataagacatcagaacacatctttaaca

SEQ ID NO: 2295 - DNA, 369 bp, Homo sapiens
ccccaaagtgccgagattacaggtgtgagccaccgcgctcggccagagctctgggttttaatcctactttagctgtagaaccttgggcaaataacttcatctttttgggtcctaattttcctcctgtctaactggagggactgtgatccttccaccttggatggaagaggcttacctgacagccagcctgcctgctgggagccaggagagtcagctcattaaatcttgaagaaccgctgtatgccctttttccttctaagtcatgtctgctgcctgtgagcctgggaaggagtgctttcaaaacctgtatttttgccctctttagtaaatttagaactgtagaggctaataaactgcgatgagacattt

SEQ ID NO: 2296 - DNA, 412 bp, Homo sapiens
gtaaccggcattataaaatggttttattaattattaataactatttaatgtgtacacagttatccatgaagaaataggaaataccagtgagttgttaccagcgttgccccaggctgggagagcccttccagctttcctttggcctctgacacccctgccccactgaccgcccaccccccattcctgtctggaaggctcgcctgccatcatcccgcacatccgacagctctcccttcagggtcacctcctccttggacaaagcatacgtgaccccttgtcaggtttcttggctgggtgctcccccagagtttggctcctgcccccaaccaagcatgcatggtgacaatgcacccacttgataactgatcactggtgtcacttccacctccctccctccatgagcgcaaacctc

SEQ ID NO: 2297 - DNA, 491 bp, Homo sapiens
tggaaattaagaaaccaaaatctttgctttcatgtttattaaagaagatcactaaagatattgactagagaatgctgtgtgctatttcaattacatttgtttttcttttattaacaggaattttgattcttcaaggaagtggctcaatttcaatttcaggtgaccaggtttatcgtgacttttccttcttgtttacttttcgctaggaaggggagttgtaggggcagattcaggtattggaataggaaaattacgtctaaaccatggaaatcttggaaatggaattggtggaagtgggcgaaatggatatgggtaagggaacacaaaaaaccctgaagctaattcatcgctgtcactgatacttcttttttctcgttcctggtcttgagagactgggaaaccaacagccactgccaagatggctgtgatcaggaggagaactttcttcatctcaaacgtttcagtcagttctttctctctgacgctgttat

SEQ ID NO: 2298 - DNA, 493 bp, Homo sapiens
ttttttttacttaaagtaaatgtggctttgttagtttctaaagaatgtacttttcttgttttacttttttaaaaagtcttttcatttcaaaaaaaaagttttgcatttgtctcaagagactcaaataggaagatcagttttcaaggcactcacatcaaattgaatggcagtagaaaaactgtcctataaattattattttattttgttctttatagtgccagtattgtgaatgccacgcttagcaatactgacactcaatctcagctgtcccttacagtttaacccacctctgggccaaagagaagaatatgctgcaatttcttgtttagaagccatttaatttaaatgcaaacaaaagctttaaagtgcgggtcaacagaattcaaatgtctaatcttaacagttcaatatttagtaccttccaacctaatgagataggaaaaaaaaaataaaaacctgggaagtagcgctgggcaccttctgatggaactc

SEQ ID NO: 2299 - DNA, 467 bp, Homo sapiens
agaaagggcttatgagtgcagtgagtccagtctcattaaatattggagaatacacacctgagtaagatcctgtgattgcagcaaatgtggaaaatgtttacccaaaggtctgctctccttggatattggagagttcacactagagaagagtccttacaagtaaaataaatttgggcagttttgtagccacacctctgtattccttcaggattatagttaacactgaatgaaggccttactagtgtgacaaatacaggatatttatccagaagtctggctgcataactcacaggagagctgtcatgtgggaggattgctacatgggaggatttgcttgagcctgggaggcagaggttgcagtgagccgagattgcaacactgcagtccagtctggaccacagagtgagaccctgtttcaaaaataaaatatataaatgacatccaataaagtatgcatatttgagctg

SEQ ID NO: 2300 - DNA, 545 bp, Homo sapiens
cctggggctgttgacctattctgaggattgttcagggtatgcattgagtttcctttcttcactaccaacgcaggatttttatcctctctactaattaattcttctaagaaataatatataaaagaacaaaaaaggggtgaaagttcagttagccacacggctggctgctttttaggagtctggatgctggctgaaaatactgggcaaaaagagacttctgcattcaggcaggctccggaggatatttcaattatgtgcattccactgtcctgtcctggccgagttaactgcatatgtcaggaaaaagagaataatcccccaacccccatctgtctcataagagaacccctttttcctatgaagctaaaacacaccacacagctccagcaatggggagccatctgtggtgtcaaccgaggtggccacagtccctgaatggccacggatgtctgcctgggagtcagcccgacccattaacatcctcgatccttctggcttcagtgtttaggaaccatagtgcttcaggctcaatctttcactctctg

SEQ ID NO: 2301 - DNA, 443 bp, Homo sapiens
gtttgacgcctgctcaaatatggaagcacctttaatgagagttgacatgacttgggggatttcctaaccatcatgctcttaacacaggtgcctggttaggcaggttccttccacctggctgagcccagacaccgatctgtgagagcagcacagtgcaagggaaggctccctgcaaggagaggctgcaggctaggctggcccttcagggtagtgttttggttctttcctgaagcaggaggcctcgcttggagcattgctttgctcctaaattacttaaccaaacagcgacttattttccacagtcaggtagacaaacaccacaatgatgaaaataccaagcacagcaagcttcaagcccactgggaaaccttcttctctccagctctcgatagtctggtcttccgcgcagtagtctctctctttggtgatagtcccatatgtga

SEQ ID NO: 2302 - DNA, 398 bp, Homo sapiens
catggcacaaataaataatctttaatttcaataaatagctccccatcacaccagacattatgctgtggaaaaagatacagaagcatccaacagagagagaggaaagagagagagagaaagagagagagagagagatctattctaactacactaattccttagcacgagagacgtgacattcgttcacagaaaaacacagaaagatcctcagagtatgattaaggaagaagatcatcatggatggggtgtgatagccattttaatccatatatcaagtctttgtatgtctttcgtgggtcacaatcaccatgattcggtcaaaaaatgttacttttgctctatcatatcctatttactttacacacacacacacacacacacacacacacacacactac

SEQ ID NO: 2303 - DNA, 345 bp, Homo sapiens
aagtttgattttgctacattgaaaaaatgtttgtgtgtgtgtgtttttttttcctttacaaaactccttccacagacgcccggggcctgtggcgggtcactgtctgggcagatgctcacagcagcacgtggtgcccacagagttcaggaggctctggtaggggctgttttagaaaataactgatttcctgttgaatcaggtacgctccgtgcgaccactcctccctccctgctccctgtccagttcgggtggtcctggctttctggctgtgggcagctgagaggacaaaagaaaggaagaaaaaagggaaaagtaaaccactgccccccagttgagccaggttcc

SEQ ID NO: 2304 - DNA, 548 bp, Homo sapiens
cccttatacaatttataatctcttaaaggaagcaataaacatttaaactattggactactgggatgtacattttaccagataccagcatcataatcttataactctatatgaaagtttgaaaaaataattataaagtttatttaaatgttgattgtcccaaggtctacagtttcttttctgttgtgtcatcagtgacaaagagtaaaaaaaggaaactcccatatttagcactttagagtaaaacacatggatcatcgttattaacagtcctctgggcgtgctggagctcactgagaaggcttctattttgagcttggaatgttgtgctgagctgtgcagcctgttcctgcatctgttgttcctgcattttctgttgctctgccagccaattttgtttggctatctccatttgtctcacttgttcctgatggagtctctccctctcctgcatcatttgctcgttctgcctttgaatcgccgccaacctttgcgcttcagccttttcagcttctgctttcacttgtgcctctgaggagaaaaagataat

SEQ ID NO: 2305 - DNA, 391 bp, Homo sapiens
aattggctatgggaatttcaatttattgcataaataatcttttagacctcaagatacacgtgacctagggacagtttacatcaatgggcaagacttaaaaatagacaccaagttcagcaagtatttgagcacctactaaaaattacacaactcccacaacaacgcattttgcgtttctaaagttgtaagcagcatgttcggacgcttgatgcaatttcccaagttgtttgggccccccccccaaaaaagtcttctcagtaaaaggtggggggaaggagggtattttgggggcaacaaaccaaactggtctgtcgcatgttaagtcaatttcacgttcacctactggtcaccacgaagccgaggaaagttttaaaaagaacattccggggtc

SEQ ID NO: 2306 - DNA, 398 bp, Homo sapiens
agattagtaaaccacagcaaagtttattcatgtgccagggacataaagatacattaattgtttgtttttctaggctgccagtataagcttttcaaaatgtttaaagtaaataaaaccaataatacagctagataccacattgcaaagaaccctaatgctatttatcagctttaaaatactttcaactgaaatcaattacattttaatatacacatattatacagaaattacctatagctcttttaaaaatcctatgacattaacatgaaactttattagaatttaagattctatatgcagacctgataaagccttaaatttaattattttggagtaatgtcttcttaagaaatggtagataggataaaataatttacagatttatctgcctttgaact

SEQ ID NO: 2307 - DNA, 420 bp, Homo sapiens
ttttttcactttttttccaacatataaaaaggtagcggagttgtctgtgggtttttttttttttttaaatggttaaatctttggtttgtttcttttttctcttggaggcctttatctctcgcacttgcctttcccactcagagaccagtgggggcccgcgtgtctcaatcttgctgtctgtctcactctctctctcactcaggtccccctaccctgggctagaggaagagagaggcaccctggtgttcatgtgggttagaaaaactagtcaggtcaagaggtcaccctgacttggctagtccctcgccagatctccccagggcttggagagcccgtcatggccttctccagggagatggatggaaaactcatatccttcccctcctcctgatctcagccccaactcctactggggcttgg

SEQ ID NO: 2308 - DNA, 496 bp, Homo sapiens
aattgctaagaattttatgtagcaagtttgtttattcagtaacataatcacaaaatagaaatatcacattcacagaagtggaaataaagagcataaaatatttttaaaacaggaaagcaatgggatcactttcaagagcctcaaagaaaacctttaatttacaatgctacgctttcatgattaataggattaatgtgtggtttttctttgataaaagtagtcatgattttttagtattacatacattcattgcatatgacagactgataaaaatgtactgttctaattacttaattgttttggctcatttaacaccttgtttaaatagctttaagacatataagaggcaaataattatatatacttaaggataaaattttcagatatttatccaaacacacatttacccattaaattagaacactaactgcttaatatgtaaaactagtttgaaatcatgactcttgattaaatacatacttcaacatctctcatg

SEQ ID NO: 2309 - DNA, 504 bp, Homo sapiens
caaattcataggatgtctttttattatgctaataatttaatcacattccatggggtccacaataaactctttatattgaattccattccataataaaaaaaaaaaagaacaaaaaaacaaaaacaaagcaaggagctctatttttgggaaaacaatgggtgctcactgcttaactggattgtattttatttggcttttcaacacggcaatacaaacatattatgaaatgagtgaaaagggcataataattttattctaggtttctactaccttcatgattaagacttaactagctactgctgcttggccataatccactacagtccctaaacaaaaaaactatgaacaaagacaaaaataatctgtaatttctcctacaaaggttaacccaaattaacttacagcagaggtgaacaaactactgcctgtgtgccaacataacccagcttgtttttattagtaaggttttacatattatctatgattgttttcacactacattgg

SEQ ID NO: 2310 - DNA, 695 bp, Homo sapiens
agtgtgacacttttagtgcacactcaaagacttgtgttttcacatgtatagaagttcatctgggggtttccaaagccttccgtattttcacttatgtgtggccttacaaaatgtagtttttaaaaaatctatggtttactaaatgtaacacgttaaaaatcactgaaaaatttgccaatgtaaatcctaaatttgggtttactaagttaaaatgaagcgttaagaccaaaaaaacattgaaaattttattttcacaggggatttgcataaaaagaacattatttttgttctgtgtatatataagtatttttgtttccttaacttgtttctgttgcccacacacaactaggagaagatgcttttctttattttggtttggccaaagatgctaatggttaaattatgaaggactttgttttacttatgttaagtggtgaaaactgtagttcttaatctatgaagaattctctaggtggctatacaagaaaaatacaaaaagttaggaaaacatgtaaacgtaagttatgaggtatttcatagatacagtgcccatacaaattctctttcccacaattttcaactgccagatctcttgctttagtcttttttccttatatttggagaaacagaagagtttgacataaaagtccctttgaggatgtgagggttgcagtagtttacagcagggtcagaaa

SEQ ID NO: 2311 - DNA, 431 bp, Homo sapiens
gaaagtataaaaatcattttactttaatacaaaatcacataaagaaaggcatgttggctaaatcaaatattcactaaatatcagtgaagtcaccactggaatctcaatagcacattttcctgctttcttttctcccttctgctaaccattgaagaccagggtcatccgtgggagcagatgagtaggacacgcgtctgcacgctggaggccctgggggttgacatgggagcaggaagtggacccccccaccctgcacatcccttctgtttttcttgatttcagtctcactggcccaggccaaatcttcaagggtgtctagttctgcagccagggagaaagtgatgccaagagaacctcgtctcctccctcctcagtctgctttgaaggggaaataaatacacaggcctagtgtgtctgtgtggcacagggag

SEQ ID NO: 2312 - DNA, 447 bp, Homo sapiens
aataccattttgagagtaattttaaagactaatgcgaaagttcgggagcacattgtatatttgaaataagtgtagtgtgtgcaaagaccattttctacctgtggataaaaatcaattcccccaaaggcctaaaagcatgaacaatgtttattttgagtaaataattaaactacatatttaacatggaaaaaattaaatgaatgtcaaacccaaaattaagaactataagcaaagcatgcagtctctgttaacaaaacttagttgtgaaactacatttttcattttgtaaatgccattatttcatttcataaaatgtaaaaatcctcagtatcattctttacacttgatgcggcaaacacttctttcctattttcctcgtatttcctgcaaaataaatctacatctcaagttccttatagttcatactttcttctcaacatatttgag

SEQ ID NO: 2313 - DNA, 399 bp, Homo sapiens
gaatcacgaagcctcagtttactcatcacaaaaatgtatctaacaacagatgtctcagttacttcacaggatttgttgtgaggtccaaaggaaggaacagatgcagaaaacactttaggaggtgggaaaagcttcacaaggttgttctcatgaatcagaaagttgaaaagacctgccatgggtcctccctgggtggaggtcagactagaggacattggcagtagtccccttcttaagctgttttgatgacacaaagaaaaggctgagattctgaactatttttttttaacataaatgccacttaactagggaccagctctgtgcctgtgccaaaccaattggtgtgagcttgaggaggagtgaaggatggggacagagcatacacattgatgacaaaga

SEQ ID NO: 2314 - DNA, 685 bp, Homo sapiens
atagtcaaagtggcagcagctcatttatttagccaaaaatagatactttctcgtacaatttggttcacacatatgtacatttctctgtatatatacacacacacaaaggcagacacgtttattctcactgaaactccaccccccaaaatcaaccggacaaacaaacctcacagcgaatgcggggtgccacagaagcgacttggggagggctgaggaggactggttttatttctttttcttactttctttgtttagttttgcttttaggtatttatacacggacatgcttacaagttgtaactatacagagcgattttttttatacaattattacaacgattaaaaaaagttttttttgtttttttgttttttttaaagaactaggatgaggagagagccgataagaccagggcggcgtccagatggttctggggccgcctgggcacgggctggaaagctgtcttgagtaactttttctccacttccaaggcactacagcgatctgttccgccttcgggctccgctggccgagcgaaggcggcggcggcagccgggtggcccgcggctccgggaagtcccagcaggtgcggaggggcagagcccagcagggagagcgggtgcgggcgggggccgggcggtgggcctggaaacggccggttggtccaagccgggaacttgcccagcg

SEQ ID NO: 2315 - DNA, 779 bp, Homo sapiens
acataattacatctttctttaattatcaaagaatcactttagaacattagagttcttccagatcactgaataggaatttcaaccattacattccagtacttagagaaaatgtaaatataattgcctttagtcaaacaaaacaaaaataatatatttggatgatgaacaagtcacccagaaagggctgaaaattagcatgacagggagagaaaacatttctgggttggcgacgttgaaacactggctgtgcattagtccaggtgtgggaattccagcctcgtcctatgttgctgggattctgtttagtctcaggcaaggacttgccttccaggccttagttccttcttctgtaaaatggacacacttgcctgtttcagaggactgaggtgatgattaagacccgtgcacctgctttggtatgcaccgcattagacagtgggctcacacttgattaggatcggaatcacctggaggacttgttaaacacagattgatgggccctactcccagagagtccgattaagttgatctggggtggagcccaagaatttgcatttccaacaatttcccaggtgctactggtgctgctgcctggagcccacctttcgagagcccctggtctgcaccataccaggctgttggataactctgtctggggtggattagacaaaattctgcgggcaggaggttttcctggccactgtcagaatacctcctctagaacttccgatttcaaagcaaacaagtttgttcagcatggacccttctttttgttgttc

SEQ ID NO: 2316 - DNA, 646 bp, Homo sapiens
aacataggatttttaatgtggaaatgtaaggaacatttacatccccagtaatgaaagagactcaagagtagaggcttcttagaagtcaatgagagaagaatccggacaagaaacagcttaatcctttctacggcagagaaacatatgctcagaattctttggtttcattttcatgtaataatttcagttcagaatatagtttatgttctaaaaaagtcttatttgcatttttagtgaggtgctttgatcatcttcaagaagactgctgggaaacatcagattcctggaaccataccacaaaggatccgagactttcacagggaggttctgcaggcaggaagtgtgctgggatgccacacaagcaaacagccctgaggagctctgtggctccattttcagctgcagggagaacaggcacagtcagttctcagatgtgctgctggtgggcagggcccactcacctgcaactttcagtgtcaccatctcactgcgctgggcctccagaccattgtctgcctcacaggagtagattccagaatgttctgtagtcagagagaggttgaaggaggcccctcctccagagggggctgagatcttacccagggtgacatcttcatgataaaaccagtacaggattggggaggag

SEQ ID NO: 2317 - DNA, 449 bp, Homo sapiens
cataaaaatgtaagttttattgagtgcctatagtgtgcatgggcctttattagacacgccaaattcaggcacaacagacacaagatccctggcctcaggtaccttatgatctaattaatagatattagaaacagtagaaagacaagttacacgtcaatgcccaatgactagagtcaacattaaagagttgtaatttaagtaatccaaactgacatctaattccaaaatcatttataaaatgtatttggctttggaatccacaggacttcaaacaagcaaagtttcactgcagatagtcacaaagatgcagatacactgaaatacttaagagccttattaatgatttttgttattttggatcttctgtttttttcttattatggtccgaagcctccttaataccaatttatcagacagaagcatgtcatcttgttgttcaagataatcca

SEQ ID NO: 2318 - DNA, 452 bp, Homo sapiens
gcataaagtaacttatctaggtctttaaatggctaggaagttaggaagttcaaatggctaagttctatttgaagttggggtaataaaataagcatcgaaattcagaacattctcaacaatcacttaggacagcagttactgaagcaattcttaatagtgctgtgaaaaggcagcaagaagtctcagataaggaatcatgctagatcataaatatttcagcaaattatgatgacatctaaaacacaaactagtcaagagaggcaaagcaggctttttgattagtaagtgaaaaatgaaacaagatgcatatcacaatacagtcactagtagacagctgaaattgatcacagtaacgtgcactttgtcactagatacaagtgggataaaagtcgatcccaaagcatgcggtacaaaatgtgcaacatccagctttgtgcagggggtcctctata

SEQ ID NO: 2319 - DNA, 477 bp, Homo sapiens
cttctcttggttttattgtttggtagaaaaacaggctctttaacactgaataaacatctcacgaactgtcgctcctagattacaaaaagtcaaaaccaatttcctttgacgccgggcccttgaatctgacattcaagtcaccgtaatagaaaccagagctgctgaaccttacattctggaaggtgcttgaacaaaggcatgttaaggaccgtttaaaacttctagcatgtaagaagatccatctttccttccaacgcctttggataataacagcagaatcccggagatctgctgctgagtttgagaaggccaagtttaaggattccaaactccagccttcaatatttctgcagaaacttagagaagtaacctccccgtcctctccgctggcttccccaagtacagatgcaggatgcaggtctttcttcctgctacccaggcaccgaggactcaaaccatctcaccgtctcatcactg

SEQ ID NO: 2320 - DNA, 478 bp, Homo sapiens
aaattaaaataaatttttattcaaagcatcttttaaaattacagcatgtttattcttatgctgttaactctgccaaactacaacttagccatatgaagcataaaacacttcaaaaatttgaatgtaaaccattttttaaaacaaaaagcagtcttaacacacctcaaattttagataccaatgtatttttccaagtatatagcttatatcaaaaagaacattttaaatgtttctaaatagttgtgataatttcttaaactgttgcaattatacaaataaaaaatgtttatgaaaaaactattagagttgacaaaagctgactggagaaacaaggaaaaacccttacttttgaaggccttaaatgttatcatctgtgaattggcaaatatttgtatttgaaaaattcttactacccttccttctttagttaagttgatcaaagttcaaatttcccaagactgatgagtgttgtttttag

SEQ ID NO: 2321 - DNA, 546 bp, Homo sapiens
acagaaggagttcaaaatttatttataaatttgtgtaaaagaatataagacctttttcttttgtacatatttgtaccataaagaaagtagggattaaaatctaaaaagacccccaaagctttcaaaacctgatctgagaattagataagaatatgtcacttagaaagacaagcctgtagcacccatagctctgattaacctgaaagcatcaagtgactccctctttttctaccctaccaacatcactctaattatacttccaattagaaaaataatgtagcatttccctggcagtagagtttaaatatgagttcaggaatcagctcctccaaacatgcataaatgaggacaaggagaagccagtcactcctgactgcacggtcaagtgtgtgggcagttgaaattaaggtaaaaacagtgaggctgaacaaaatcacattaagaaaaagcatctcatgaggcttttcgaggtcagttgatgaaggccagataggagtcaatattttctcatataccccagctgttaccactattctattccaacag

SEQ ID NO: 2322 - DNA, 567 bp, Homo sapiens
gcgatggttctgctttgaccgccaagcccgccgcttggcctactatgcggacaaggaagagaccaagctcaaaggtgtcatctacttccaggccattgaggaagtctattatgaccacttacgctgtgccttcaagagccccaacccccgcctgaccttctgcgtcaaaacctacgaacgccttttctacatggtggctccgagccccgaagccatgcgcatttggatggacgtcatcgtgacagccgctgacgaaaaccacgccccctgagtggccccgccctcttggggggaagtcccttcgaggctccgccggcgcggggcgcgggggcgttcctaggccccgcccactgccggaaaacttggacgcaccgctttggaactctcccgggaattccgcaggcgcggcagttcagctggcctgagctgctgcgttctgggttgcaggtgccttgcccccgacgggatcgccggcccctaaggccctgcccggggcaggaggaagattgcaggggcgggaagaaactatttattggtgctcctgtgataccgaattaaatacggagg

SEQ ID NO: 2323 - DNA, 543 bp, Homo sapiens
gcatctgttctgtgcatattttattgaataaataaaaattttattggtttggtttttaaaacctataaacaatattcttagtttgatcacttaaaacatacaactttatgtaaccaaaatgcttaaaggattttgttcactgagtgttggctatttatacctatacatatgaaaatctgacctgtcaaaactggttttgcagtagccagatttgagatatatgtggatttctaaaaggttaacttgtcaaattatgagatctaatacaacacccaggtattaagggaaaaaatgattttgcaaccccaagttgggacttaacataagaaatccttatggtgttgccaacgttaaaaattctattgagcactttcatttttcagaataaaacaggataagcaaataactcacaacagtacctcatagtcttctataaatagctaagctatactttacagctataagaacgtgatatttgtatttccctgagagcgtagtttgctttgagttcaagggcatggtgtatgtgtatatgtgtgtttc

SEQ ID NO: 2324 - DNA, 732 bp, Homo sapiens
atctgtaagaaaatgtttattcttttgaaccccacaggaaaaaaaaaaaagaatgcagccaagaccagtatttaacgaagtgtcccaaaaggcagcaaaatgggggaaacctcaaaacaaagtcagtgacaattttccatgtttttgcacaaagaagagaaaatctatgacaattctgagtaacactttcatggtgacaattacacaagatgattcaaaaatgcaaaatggcagcaacatgcacacctggctaaagctagaagtattttttttaatctcaaaataagatctgtgatttaaaggatgattctttttaatacttctattttactgacttgcttgtcctacttaatttgctttaaatgagacgtacatgccaattaacaggaaattttagaagaactatgtccttccagaatccatggcaaggaagcaaaaccaatttatttggtttcttaatttttcctagtttccaaatacaattttgcattgcccccacccggtccctcccgccacccccaccctgattcttaaacacttccaaaagttgcctgtgcaaacacttttctacccatgtataatacacatttgaaactgaaatctttgtgcagagttttgagtttaagagtctttaaaaaaaaaaaccctccttggcacaagagctgaggaatagtcaagcttcttttaaatcatcaaacacaaaatgatgaaaagtggagaaagcacagttaa

SEQ ID NO: 2325 - DNA, 630 bp, Homo sapiens
gcaactttttaaaacctgactcttcttaggaagtgctctctttgtacactttgtttcttgagacttcctcctattaattttcttttctttacaaggctgaacttctgtattcaataagttgcaaacactctcttctacaacactgaccaattgatttcttctgttagaagtccttgttattctaccaactttaggagaggatattttctcatggttatttgaagaactaaaggtatcagtgcctgaaagggtctcagagattgatgatttattaggagaactgagaacggcaaatgatacttgaagtggttctatgttttcaagattctcccccttgtcatcaaaatctggttgaggtaatggctcaggaacaggtgactgctcaagcagcagggaactgagaccactgaagtcttttttacaaacaggtgttcctcctttacgcaatggagtatttgctggcaaagattcatcaaacacttccgggcttaagtcctctccaaaagtaactctcttcctcttcctcatatttagaaaggcaggtgcttcaaaattttcttcatcttctgcttctttctctttgcaacagtttgggagatttgagattaagctcggatgagtcccatcatc

SEQ ID NO: 2326 - DNA, 428 bp, Homo sapiens
gcaacatacaaaaactttaattatttttgcaaaaagaaagccaactattcgccttggaaataataatgaagtacaaatagctctgactctgcatttggacaaggatgaaccatgatagatatttagaaagggttttaaatcatgtgtatgttggctacagagtaaaaggaacagagaagactcaagctattgtcaggtgtgtatgtgtcatcagcacacactgggggaggagagtcctcactaagtgccacaacccctgatagctgtcagtctctcatgaagcaccatgatctggcatggactcccaaatgccacttgagagaaggtcttcacagcagactgtgcatctgtgtcacaaaacacggctgcaatgaacgacagtgttcattttttgcccttccaaatgtattcttgtgtatgatcgaagc

SEQ ID NO: 2327 - DNA, 687 bp, Homo sapiens
ttaaagagatgaatttattggtaaatagataaaattaacacctattttaatatatccaaaccccttccttatatatattaggtaaattaaaagaaaaaaattatcaaagcaatactacagccagctacatcgccaatttacaaatgagttagtaagtaccataagtttgtttgaatatcaggtgcttcagagtttttctcaaacagttacaaaagagattaggttcccaatcagttcacaaaagctaatttaaagaatgtagcttaactacagtactgaggttgtcacacacttaactttcggtctcttgcttatttattcatatctgaggttcactgtttctactaggatacattccgcccacacccacaccttggtccccacatcaagcagctcctcacagcaggaagacatccgctatcagacatggttttctgaagttgtgcttaggatttcagaggaggaaaaattcagaggttctaatagccttcggtaactgaggtagaatatggggctcccaagaatatcttccatatgccccaaatctgtttccctcccaccaaaatccagctctgttcaaggtcaagtttgagaaagatacgtgttctcaatggtatatttttaaaatccacatcaatttttaagagactacctgctaaaggagaataatggctcactgcatctttt

SEQ ID NO: 2328 - DNA, 447 bp, Homo sapiens
gtcttacattttttcttacaacaatcttttgagaaaagaatagagaatgtttaccaggtagaaaaaacctgattccttaacaagacttctcagtcacttgtttctctttccctttcacttttcctttgtgcttttgaaaacaaaggctaaagcaggtgttataaatttattcattcctgtgctagagagcatggaacacatctctgaagtcaactcttcttttggtgtatcacgagttgaatccttaataaatgactgccacaaagaaaatttctaacagcaaatctttttaggaactgctcaggttttgccttcgtcttgacacttcattttaaaatcttggtttctactgatgtgttttcaaaaaagctgacaaactcggtctgaaatgtagacactgaaaaaagtgaaaggaagagaacatgcaatataagttaatcattatca

SEQ ID NO: 2329 - DNA, 449 bp, Homo sapiens
agcatatccaaaaatggtattgctttattttttaaaaatatatttcttttttgaaatatcaatcgaatcaattttattctcacaacaatcctgagtaaatatttttaaaaaatatattttttgaggaaacagattaaaagctttaaaaaatgtgattcactgaaaatcaaatagtgaatacatgatagagtcagcactaaaaaggcagatatatcaaagagagactgaaataagcaactcattttttgcatcgacttcgaaacacctctttaccatcagtgtttgtaataatcattcttgatctttatacttcacatttcttggtaatccaaatgcttcataaattctcttacacatcctgaatctcttgcttcattcagcgagataattcctggtgagcaggaatgcatatggttttcagatgtagaaactgggatctccagagacaa

SEQ ID NO: 2330 - DNA, 748 bp, Homo sapiens
gctgcactgcttagaatttccagtacaaggttaaagagtaacgggttaaattttgctattattatagcaaaaatgtcatgtttgtgatattaataaacatcagctaagttttcattgatacacctgctagactaacactaaaaagtaattgcaaattagatatttaaggatctataaatatcttttataagtagaatgtattaactagaataaatttgttaggtatgctcattatgtcaatttcatgtataaatttctcttcctttctaggtgattgacatatccttttgtcataaaatcaaatttcaaatgccaagacctattatttcaatgtagcattaaaagctagcaatcactgaagggaagccaagttcccaaaagtttacttgtagctgacaaaaagaacagacagttctgaagtggaaaatgatgtcccgagagaacacagagtaccaacggagtatctgatttctcagggccttcccaggacaagggagctgccactgccaagtgctccctagcggcccagcaagcgagcttgcaggtgatgggacctgcagtgacactgccatgtggataatcaggtgtcttgtctgtattcttttatcacaaattattgttcgttacttcaagaaagaaacaagaaataaaataggaaaaaagccagagacaagtcttttttttttgccctgctcctcaaaaacgagaatgagaatttattctaacacatcatcttttcagcagacag

SEQ ID NO: 2331 - DNA, 500 bp, Homo sapiens
cataactctggtcactattttcatccgcatctgtcacttctgatgcgtctctaacatttataagatttctctggggagggatttgacgtatccatgccccacctctttctacatttatgggattgagctctccaccagccacccatgggctgatgtctttggaatatggatctagtaccaacagagtcagaaaaagagatggggtccaatgggctacagttgggtggtggtcctgggatacacagcacagtggcctctactgggggatggcagctttccaggagaagagtcgcaagcttgcctgtgggacttgtgtcttgtggagaggacagggctgcctcagcttggggagacagacagagtgttccgggtcccctctttccgccgcagcatgaagtctctgggggcgactggactcatggcatagaagacgttggcattgtcaggaatcaggagcacccggtccccaggaaggacttgaaagagctgatagtcacagg

SEQ ID NO: 2332 - DNA, 753 bp, Homo sapiens
gccaacacgtctggcttatttttttgtatttttagtagagatggagtttcaccatgttggtcaggtgggtctcaaactcctgacctcaagtgatccgcccatctcctcccaaagtgctggattgcaggcatgagcgcctagccaggaagctatcttttcttgagttatgaaactttgcaacagttgttcaaattggtgtttgtccttcctatagctttcatattttcaaattaattctgtatggctatataatttatgttttaaaaggcaattctcttgactttggaaatatggaagtctctcctttaacctattcttgttcccattcccagtctcatttgaaatcattccttttattgttagtgtgtgtatttttgttggtgtgcttttaatgcatccaagtatgcatcattttggataaaaaatacatccaaattaagatgttttaacacataggacaaacttgtgcactttttatgccaaaaaaaaaaaaaattgggttttccttcatgggatttctagaaacactgcctacactttatgaaaactacatagtattcacctgtgacaggtagagtttatcactattaattttatgaggctatttattactttccaatgcatccacttagaacaagctaagagtaaggctgctaactttaattccttgcctgattttattgtacagtgtgcacaagcacaatggtatgcttgtatatagaaactaaaaatactatgaagtacataagttcc

SEQ ID NO: 2333 - DNA, 565 bp, Homo sapiens
tatttccatgaattcaaagccttttaatgatgtgaacacttactccccatttcttttttacattgttacaaaaaatttacatacagttttctgaaagtggcattttgttggttgttattatactgatgacacatattaacactttgtattgaagaagtatcataaaaatcacagggcattacagatttttgataagaagtagtaatagcattgtcttttaacagctggaggctcccaggcatactctttggtgagaaatgattaattttatattttcattttgatgagaatcttttcttgtttttaccagttataaaaacaaagctttttctttgttgtgatactgtgcactaagacttagtttcttgagctgatgctaaataaaatgagatcaataggaatattccaggaggtcgtgagaagtttttagaaaggatggcatctacatatatatggagctctgaaaactgttggagagtatgacctgggactgaaactgtggagcacatagccagtgtcacaggctccgagagcagagagagtttgctctgggacctggaatgag

SEQ ID NO: 2334 - DNA, 556 bp, Homo sapiens
aagattgcaaaacactttatttccatcacatatgtgccaagacttgtgttctgtatccaggagtgtgttagatactaacatagtgtttcatttacatgtgtgtgaaacctgggtgaagagccagggtttctctcccccacccgcctcagagtgcttgtcctggaatcagagtgtaaaaccccctcttgaagcagacaccaaaactgaacttccacccggtcatgggccctgctcttcctgctgtcagcctagtccaaagagcaatgagggaactgcttaggaggggtctgagggtgatgagggcctgggggccacacaggggtgggtgctgtcaggtacaagcccatccctgcctgcaaataaccttgcacagggtccttcctcattctttcctcttcctttttgtttatgagatgaatggctcttctgctgtggctttaggggcagtggggaggcagggagctatttgggaacagcctggaaagctgaccctgcagaatctcccagaagccttggtgtggctatgggtacccaggctgtagaaatcccagatggt

SEQ ID NO: 2335 - DNA, 538 bp, Homo sapiens
tcataaaaaggagaaggtaagattaccagaggttgtcatgactatgccagtaacagatctatcccagaattataccacttaaagcagactgttagaagccccctcagtgcagtgggcagcacgtcagtctcataatctcaaggtcctgagttaaagcagactgtataggaagatctatagaaacccgttactactaaaggggaaaaaaaaatactgtacttaaaaaaattagaagccagtttaccattagagagagttttgatttgagatataaagaacatattcctctccaaaactgagtttcctctgatacaaaagtatttgccttctggagaagatatggtttgcaccgtccaacaggtgtgctctgaaggcccccactgaaatatattgcatcatagatgaggggaaagacttggttaatttctcttatcaaaagctagtcttcaggacatcctgtccaacttggctcccaggggcccaagggttcttctcagagattgttcttagagacccccaaacctgcagcccaagccca

SEQ ID NO: 2336 - DNA, 375 bp, Homo sapiens
ttcaaggagagtcattttattatgaatcattgtgcaaagaacataaactaaattgtaagctcttctagggcaacacccaaatatcctaattttgaattctgtacttcaaagtgattataaaggaataagactttttataaaacaaacgtatcatatagctcatatatgcaaaggagttttatcctttcaaataagtccctgtatcgcttaaaacatttttggaagttctatctaaaattttgtttcatgtgaggcaggtgtcagcaccgaaaaggtactaggtccacttcacactattccacctggttagaccatactcatgatggccagtcagttatgggaccgtaaacaaaatgatactggactagcttagaa

SEQ ID NO: 2337 - DNA, 710 bp, Homo sapiens
taattttattgatgcttcagttttcataaagtgcaataaacaaaataaatagatgaaaaaagctttgaagatttatatacagttttgaggttaagataaattactgactatattcctttcagccttttaactctgtgaaagctgtaacgtacattaaaagcacattgaactaggttaaataatgatctttcccccttagatcaatctagtattaaggagtatataattatgcaagttcattctataacacgaggctagactaaaaggaaaatttttgtgctacagactaaatccagatacggtcaggtgctgagcagtattcctggcttcaaaataggaggtatctgtttcatcatctggctgggggatgaaaggcatagtctgatgctgcagattttcccagtccacatcactgaagagaggatgacgttttagctcttaggaaaaatataaaacaaaacagtatgatatcattacctaagtaagtactgctttacaggaattattataaaaagagaatgtctcacatataacttaccttactttattatgtcagtttcacagacatttgtttaatgtctgttaggccacatacttcacaaaggtctacatgggccattttgaatatcacttggcatatgacaggtgcctggtttgtatttgtttaatgacagaatgaatgatttgccttaacttagaagcctatcttt

SEQ ID NO: 2338 - DNA, 501 bp, Homo sapiens
caaggtgagcctgatcacagcctcggtagtatttattttgaaataaaagttcccatcccttgtaggcctcgctgtgaggcacaacgtcttcgaggggaagttgaagtggggtcttcttattcactggtccctagaccgcaccttctggtatcttctaaggcaattctggtaccgcactgtgtctgggttggcctatttaaatgtctgagccagctgttccaggatttcaatgagtttctcctcttcggccggtgaggaggacgctgtagcgagaggcaagtgtgtagaaactggcttccgatctaaaagtgagagggaaccgcagagaggtgtgagctgctgcagcgtggctgggtccatgtccctgtgctgctcaggccttgaaccgacgcctgctggagtggcagcaccctacagctgttagacccccatccctgctgtcaaaggtcccacagggatcaggcagcatggattgatatgtaaagtgcagtttgggaactg

SEQ ID NO: 2339 - DNA, 475 bp, Homo sapiens
ccatctcattattttaatcattttgtcaaaaaatctgaacatgtgtacataaatacttgatttgttaaaagaatgtgtagcatagaaatccctgagacacattcaaaaatgacttgacatcttgacatgtattcaatgcaagtattcaccaaactaaataccaaggacttggctcctttccctgatatttgaggcatataaagctttaaaaatatatataatatactatatatataatttacatctttaaagttaaattatattttctttctctgattcctggttttctgccagtttactgctcctgcatattgtcagttccagactgtaaggaagccacattggaaagcagataagcactttcaaccttagggtgccagttagtagaatgatagcacgtggaactaggaggtcccaacagatgattttgtctaacccactcattttgcagttcaggtgacagaggctcaaagag

SEQ ID NO: 2340 - DNA, 560 bp, Homo sapiens
cctgagacacaaaaccatttatttttggttcatttcagtatctatagcagtgcacaaataacacatttccatccacatgaatagttcccaattgttggagcaaattaatcttttacaagctactgagcagtgaggttagaagataaacagtagatgaaatcgtacactttcccctgtatgtgaactttcttattacaataaactcctacatttgagctcaccacatccaatgactgcccctctctgttcatgtggcggccccggctgccccctgccacctctgccctgctgaggtagttctctgatcagccacctgggtggggcatgctgccattttcagtttggaaggaaaagcctgtaaatctgcttcctgggaagagagacactgctgaattgtcatttgcctccagaatgcagaaaacatcaatttcattgcagctcatcagggttggaaacacctgccacttcctttctcggttgcaattaacatggtgcatcttggcattgattgattccaagcagcctaacactgccaaagtcaaggtttaaatgaacagtac

SEQ ID NO: 2341 - DNA, 398 bp, Homo sapiens
ttggagctgatgcctctctttattcatgtatttcatcccctgctgcctggtttctcctgaatccccttgttcccctaaatagcacccccagtccccgcccctagcccagctgcaggtggagtagcagctgctgtctccattcagcagatgggcagactgaagcccaagagtgtggagcccagtctgaggtcacacagcagtctcctgggttcccacttggccttcaatggggagggaggacttggcctgggctccgtgcgccctcactgcagggtggctggctgcggccacgtcgcagggagctgccaatctggtctctgagggcctccagtctctgggccaggtttggaaccccggccccacctctgagccctggtgatgtcttcgggggcctcaca

SEQ ID NO: 2342 - DNA, 843 bp, Homo sapiens
cagtttacctacagttgcagtaccaatcctttcttgaggagttttaaatgcatggttgagcaattaaattgtatgaggatgtgacatggattagacaatgtcggtagtaccaaactatttcttggctgctccaacatgcggagatgacactgcttttagctcatgacagcccaaggggaatgttttactgactatggacttatagcttggtggaaattaacataggacgttaattagcaaaagtatccaaacagaagagtgaatgaaaatttaaaaataaaacaataatggtgtataaatctattcctgaatgtttttcctgactacctttctaaagcaacaccttccatgtgctttcactaacacagcctcctttcctatgtgactggatccgcttcttcagggccatcagtgcatcagtgagaatagctactggcaaacacgttactcagaggtgttctgagaacggtgctgtgaaaaggacttgtcacttttgagctattgagctcccccatttctgagacctgtcattttgttaagacatgattgaggctgagctccagataagatatattctttacggtacacacatacttattagattcaagcacgtttcttagtggcaggcagtaatgactcaattggaaacaaacaaaagggttctaagttgttttctgattacaggcactaccccgaagcttcatagacatatacattttataattcattcattagatgtgaggggataggtccccagccataacttcagagcattccagagaacagagtttgccgcttcaaaaatacaaagtttccagcatgcagtcaagcactttgacaagg

SEQ ID NO: 2343 - DNA, 978 bp, Homo sapiens
gaagtgggagccctgtggcccaccctcccttctccaccagcatgttggtttgaaaaggatagggaatttagaaacagttctgtactttggtttggtttggttttctgtttgtgattgttttcatggactgttttattttttcccaggaagagtctttatcaatatcatgtgcagctcactcatggaaatggttgcaaaccaatcagtgtaggaagcttaaatggggctgtttccctctctgtgtcgttgtgaaaggaagagtcacacagtacctgtggattttcagggactctgtttttctccggtgccttagcaacggcagcagccatttgtattattttcaaataattagaaaaacagttttcaactcatcctttccattcattgctctcagagttgtggtcactgacttttcttttgaaaaccgcctccaccaacacccccgtttgcctacaccaccccccttttacttagtatgtttattttttgtgtgtctcttgccttcctcccacgttttatttcccctcagagctgtgaatgggcaggtctgtctctggtttggcatcactgagtttttcccatgcattggccccagggctgctaggatgtgagacaaatctccctacaatgggcttgctcccattgtctgtacagtttaatagatgctggcatgtcggaggttacccatgagtcaaaatccgctctccatgcttactcttgacaccccattgaagccactcattgtgtgtgcgtctgggtgtgaagtccagctccgtgtggtcctgtgcttgtactgccctgctttgcagttcctttgcacttactcatcgagtgctgttttgaaatgctgacattatataaacgtaaaagaaaatgtaaaaaaaaaaaaacccacacacaaacaaacccatacgatctgtatttgtatatacacgtgtccgtacaagtataactaaataaaaattaaagattttcatc

SEQ ID NO: 2344 - DNA, 406 bp, Homo sapiens
aggctgtggaggactttattcattagacccagagagccatgagtgcctcccacgaagtccccactgcagggagccagggtcctagatgccaggccaatgcatgtgccgtgagctggccgaggggtctgctggtcccaagagcgcctctgtgttcttcagacagctccgggtatggtggcctcgccaggtggcttgaactatcttcgctgccatttgctgctgcctcatctgctggcggatcttaaagcccctccaggcggactggatggctgtggccgctttgtcctggcgatgcggctgcctgggactcagggcagccagctggtaggcggaggcccaagacactgccccggggccctcagtgccctggcccatgccctgcaccacacgggtgggctgtgtgcgt

SEQ ID NO: 2345 - DNA, 420 bp, Homo sapiens
gcgctgagctgcttatttattgaaaataaacgacggaaaagtctggccttgcctctgtgcaagcttggaggcctgggtcgccgctgtggacaagcgtcttagtgtcatgcagaccagaaggcagctgcctgtcccagggccggggcccacctcactgcctctgatggggactcccagcccccatggctccgctgtgccctgggcaggggacgggctgggggcaggggagggctggagcccaggaggcagcacagcagccagaaagccgcaggcctgagcctgcacctttggttccgggaggggcttgggcccctcacccaggtgtgatccctgagaacaggaggcccagccaccctgggaggaggcgctggagggcggggcggtggtggcccccgtcagtcccctcaaccccagtctcag

SEQ ID NO: 2346 - DNA, 655 bp, Homo sapiens
ctcagataatttaatcagaattttaatataaacaggtcattatcccatattttacatgcagaacgatttcaatattccaaaaaaaaaggcgtcttctgtacatggtgctacttggctcttgtaggaaaacattgaaaaaataataattgagctgttggggggttttgtgtttctgagttgttttctgcaaaagctgcagcacatttgatcctgcgttgccaacgcacagggccgaggccacccaggcacacaaagggacgaggagaagcaactttcaggcaaagtgtaaagactaaacaagctgttcctgaatatgtgcatggatgcacacttattttgaggctcttccttccttctccaatgggaccaagagccacagatttgtgatctggtttttaacaaggattttcagtggcccgcacccagatagaaatttggctggtggctggttctggaccttgactagtatcagaaggtaaaagtaagctcaaaaagccattgtgtcccctcccctcactcccatttctcggggacccttaaggaaatattcaccttccattgcactccctgaaagtccaccatgttcttttgtatgttctaggaaaaaaaaaagtgctgacctgttcttttcattcccaacctcacctcgcatata

SEQ ID NO: 2347 - DNA, 596 bp, Homo sapiens
aagaaaagagctctttattccacgtcgtccgatatttttacacaagtaaaataaaatgcatatctctatataccgcgatctgggtgggaggcggcgttctggaacaaacgctgccgccgaaccctgtaaacatgatggggtggagatgggggtggcgggcggcaggcgtccatcagggaggacctggcctggcctgccccacgggtcggccgcccggctggcttggcggcgtggagagagaccccgtatgtacacacacctggctgctgagcacgctcttgtgtccgctgggggtcagcagggcccaagcactgtccacagcaccagcgccaggcccaggggggtgaggctgcaggtgaggctgggtagggcacctgagccttctgagtcaccagtcccgccacccccgctgcctgcctggcccagacggcagtggctgcgggtgcggttcttgcgtgaacagcctgcgtccggcgagggcccgaggtggggaaccctggtggctcggagccctcgggccgcactgcagtgagcgggggctcagcagagccaggcagagtcccaaagggtgagtcattgatgtgccgtgggccaga

SEQ ID NO: 2348 - DNA, 762 bp, Homo sapiens
cttattcagtctccgtagagactgtcaaaaattgccagcgctgattatatttcaagtcatcacggtggggtattgggaaaatttccaattagcaataatcgcgtctcggataaatctcattggctacggtactgccactgtgcaaagctagcttgacgtaggactttgatggtcatgtataacacctcacaggggcagaacctcctccatccccgactccaaagactcatgtaatcagtacgcaagaaagttcagagatgagacctctggttgtattccacctttgggacatgggggatgtctttagttcaaagtcacaaataaatgcaggttctacaattcagaggcttcatatccctgctggagtattacatgtttattcaggatggaccacttttcttagcaacagtttctaaacctttgccaggtctgggaagtctggcaggagagatttctaagaaccaatcattcctgcacacatttcttgaagataatatacattattccctagttatctcttcctaggtttttgtaggctcatttcaatattacaacaatctttattggaaaaccccaagtattttgtcttgaaaaatcagcaatccaggtattaaaaatagcatggaatgcccaattttactttgataattacatggtagtcagtttccgctcctggctaaagccttggattttcttctgggcagttcctaaaggcacaggtggcatggaagaaatcattccattttcgtctcctccccttat

SEQ ID NO: 2349 - DNA, 449 bp, Homo sapiens
ttgcgtccacttcctttatttctcatcatttacaaaagatgtacagagagggcatgtgttgggcacggagcaggtacaaggggctcctccccacggggccagaaaaggggggaaagaggttagggggcaagaggtgggccccccagggagagtcctggagcccctggaggggaagaaattgtcctgtccccccattccgcctgctttactttgaaggtctcggaccccaagccagtgctttggagctgctcaggctgccggggtggtctggggagggcagccaccccccgtctcagggacccgcttcttggatctgctgctgttgctgctgtcgctgccattgccagctctgaacagcccctgggcaggtgcactgtggggtacgacctcggaccccgcctcagggatatgaggggtgctgagcggtcattggtgatggtgggacgaag

SEQ ID NO: 2350 - DNA, 932 bp, Homo sapiens
ccggctcctccccggcgcacagctggattccggaatctaggccgggcgtcaagagcccgaccccgcctgggcccctcctgcccgccatttctccagtgcgcggctggagtccgaaggagacaccctcccccgcccctcaccatccggtggataaaaatagccgcgcgcaggccttgggaacggtaatgggagccacatgttggccagatgtgcctgggagggaccgtcaggaatgcggaggcccaggccctgcccccgcgcaggccccgcccccagcgaccagaccggcgtggcgccgtgctaggcagagtttactttctcgcgtttcccaaagtcgtgtgcaaggacgtgggtggccccagccaggtcaggccgcggtcccttcccaggcccaccctcagtaggtctgcgtctgcgtgtggatgacgcgcggggtctgggacttctgggtcccctgcatcacctggacctccagccgccggcgctgctccttctcgctcttcagctcctcccagatgtcggtcagcttcctctccagctgcacctccatcagctccagcgccctccttagagactccacctcgcccctcagcgacgttacatcaactccttcattcttgttttccgtgtagttttgcgggaccagcgaggggagcgcgagcgtctcttgggagtctggaggcggcttgataggacgtgttttttgggcaaaggctctttctatggggggcacctcctcttttggagccacttcctctttagggggcaattcctctttcagggtcacctcctctttggaagccactccctctttggggagcacctcctctctcagaggcctctgctcgttggggggcgcctcctcttcaggggtcctctcgtcattggaaggtgcctcctctggaagggttgtagcctcttcgtgggggtgg

SEQ ID NO: 2351 - DNA, 907 bp, Homo sapiens
cagttctcagtcctctttttatttgaattctcagcaatattcacagaatcatcactctccttgaaatactttcttcctacttcactggcctcagtctcctttgctagattactctgcccctttccatcctctaaagttgggagaactccaggatttggtccttggtacactttgaatatattccctccctaagcagctcatccggttctgtggatttatatacacacggtacacagtgaaaggctggtatacatttcagagtcaatggcatacataacgctgactacagctttactttgaaaaacaaaactaagtatcttaacattttattttacattatatttaataaaaattatacttacaactacccagtaactcctagaacaaggacaaactcaaattttgttttggtgacagttttctgacaagattaatagagcacaatggacaggtcccccatttgactttcaaggaacaatcataaaacagggtaatctttactgcatcaaattcccaaaactacgcctttgaagtaagttgacataatacttgttgtttcttctcaaatttttaatggttctccacggtatgctaggtccttattttctcattggctgtaatttgacaagttctccaaaagcactatcatgaacttaattagataatactttccagctgtacttaaatcagaaggatcgtaggcctgataagcaggtcaacctgaagctaccaggcagctctggaggctcccgtggccatagctaacagtgcacaggagggcccctggcccaggatgagccctcagaaccttttagagagagtgaaattcagggtctactgggtgtccaagctgcagagtggagcgtgagaggtcagctgccatgtgatagaaagagctgacataaga

SEQ ID NO: 2352 - DNA, 456 bp, Homo sapiens
ggttttgagctttataaaaatggcatcatactgtatgaactgtcttgctttttcatcccacgttgtttctgagaggtgtttgtgatggagcacagggccacggtgcccatgcattcctcaatcatttctccagtcttctgaggatgggcttctgggttgtttgcagccttttgcttgtcccagtctcctagtttctccactgcacccgggagcatcacgtttgcaacaggcagggcaggtggtgcatcagatgtccaggacacagtcatttgacacccaagaaaggagggcctggggcctgcatcaggccatggctgagtgggactttgccaggctgtctccgcacccagcgacaggactgtgcgtgctgctgcttcttttgtttcctccacttctgttccctcatccagagagggcggaagagctggaaacagaggctttgtcagggaataagga

SEQ ID NO: 2353 - DNA, 489 bp, Homo sapiens
caacatcacagtcacaaatgtttatttggaggacctgacagccaggtctcaattgctaaagtgttgccacaagaaggaagtattaggcttgtcctgtgtggttcctgagggcaaggccaggtttgatgggcaagggtgacaagaaacccattttagctcaaggtgaaggaggatgttcaggttgaagctgcccaggagaggaacaggattgctgataaagaagtgtcctgtccctgcatgggttccagcagaggccaggtatgcagggacgggcactgctcaagtgctttccctccctgcttgtgcttaaagtctgattctagggaagactctggggctggtgcctcctggaggccctctgcctctgtccctacatcatttcctctggaactccggcctcactggtttctgcgggaggcgcttacgtgcaacaagcctggcccgcatccttgtctcaggaccgtgggctgtctctagggtggtgaggga

SEQ ID NO: 2354 - DNA, 907 bp, Homo sapiens
aatgacaaagacatggctttaatgttatccaggagacatctgattcacatagggttactgaacactagaatctgatcttgaatctctcatgtcaacaacagacaaatgcattacaatttagggacagctgttttctgggtacctcccaggtgtttgcagaagaaggctagaatttgcttccaggcatcttcctgggccttagaatgagccctgggctccccaccccatataacatgtttgttcagtaatctgtgaagggaagctgggcacagggggaagtaaggaggctcgatgtaatgcccagtcccagggtaacagatgatctggggtttttcctttccatgggcctgtaaccgttcagagactgtttgggcatacaactcacttctccagttatggtcatcctgaccaacaatgagcaggatgggcccctgggccttctctattggaatcatgctggggttcttgtaccctcctacgagagcattccttatatccacgatgtccacgaggcctgagaaagctaccttgattctcctcaggtcatagcccaatggtggaatgctactgtgcttatagttgatggctgtgttcccactgatcccagatccattgatggaaactgtggctgagacattcttcaagaatgaggccattgagagacaaatatcagctcctagagaaatgcccaaaagcccaatgcctgggccttttacctggggatgttgaagcatgtagcatacggcctcttcgaagtactccagggatatgttgtccatgttattggggagatcttcaaagttataataagctagagccaacgctgcaaagccatggccagcaaggaggctggctcgatattccaagaggccccctccaataccaaagatgtcaatgatccctggga

SEQ ID NO: 2355 - DNA, 468 bp, Homo sapiens
caatgaataaacatttattgagcaccggcaaatcccagacactacagaacacacagaaggcatggccccacgccgagggccccagccccttgcaaagctgccacgctgccaaaaatggtggcgcatgcagctcaggcgcaggctgaggctggggcttggccgggcagtgcacttggaacggggtcctaaggcctctgccaggttccagctggggcaggggtcacgtcgcttcctgagagcagagcaaataaataatggagaggcaggggctggggcctgaggtggaggggctctggcgttggcttatgtgactccataggagcaagacaggtggccgggagcccccaccccagggtggggaggcagagccaggggaccacagggtcctggggcctccctggcacctccactggtccctcgcctctggggccaaagcagggtgtggggggacaccccagaaggcactgc

SEQ ID NO: 2356 - DNA, 479 bp, Homo sapiens
atttataacatttcctttatttatcaacagcaacgatatgacattacaaagtgacccatgacatcttttttaatcttgcacacgcactgcagcaaggttaatcctgtatgtgaaaacctctgagtgactatctcaaagtgtatatgtcatataacctgctgagttttctgatattgtaatactagatacaagatgtctgaataactccttacatttataaattcttatttaattttatagctttaatgcggtccatcatttctaataatgatattggctacaagaataatgatcatattatttatcatataatttaccatttgtaaagcaacaaattgcccattaacaatgaaattgtagttacagcatctaaaattattagaaaattatattagcatggaaatatgttcatgatatatcactgagtgaaaaaaatctggctaccaaatatgtagtctgactcattcttatttcaaata

SEQ ID NO: 2357 - DNA, 631 bp, Homo sapiens
catgaaacaattcatataaaaatataaattttaaggtcactcacagcaaaatatggcacattagaattatttattaaatgctttatacatataaaggtaggcacttcataaaatttgcattttggtaaaaggcaacaatttgatgtcagtatcttaattgtgtcattaacttttttaagagaacagattatcaaaattttacgaagaagaaaaaaataatagttttaaggaaatctacagaagggaatctgaacttcatttcccactttatttttgcgagtctgttgtgtatcttcatggtcaagttctgagatttttgctccctgacctaaaatcctgtgggaataattgatttctcatcttttacttggaagtgaagtgtctgctacctgtggaacttgatacaattttttttttctccccacagttagaataacctttattctgatccactataaagccagatgatttttaggtggcagtagctggcattgaagagttcttggcttcaagcggctgttgagtctttttggtcttgttttaactccctaattaaataaataagatccaactctttctgttgtattcactcctggacatatagaaattcacttcacacccacctaaaata

SEQ ID NO: 2358 - DNA, 726 bp, Homo sapiens
catttagtgcaagtagcaagtttatttcctttgatatagaattaacagagtaatgatgcccaaatgaggtaatattacatttgcttaggaaaactttccttgaaacacttatttagatctttgttaaagttattgattgtcagatcagagaaattgcaatcccaagtttattcataaaataaaaaaagttgttactttggaaatttcaaaatggcaattttatctcagagtcataattacaaggggaaaaatactctcttagccaagatcaagaatttcggcagcactgcaattctgtttacatccacgttacacaaaagcacatgcatttggcaaagagagtgcatacattcttattgcatcatttttcgttatgtgctcaattgccttatggtcccctagagggtctacttaacatgaattcaacaatgatgataatggggtcaccagtcatttccttacatatatagctctgatgtattcaattacatgtttttgatgttgtgctggtagtatatagatcccaattaaggagaaacttgggcctatataaacaatatatatggaatatacatggatatgtaaagacttgaggttgatgacctgacatccattaatgttaaaaatagtaaagtaaaaattccagtggcttagaaagatggtattttcttaaggacacactgctgaacacatggccacctacctgctctctaaagcaatatgtat

SEQ ID NO: 2359 - DNA, 431 bp, Homo sapiens
cttgtccaagatcatttattgttattattatttttctctcttaattggattcagcgtttctggctcctcacacacatcctctctggtgggggattcaggtttgtgcaaagcacaaaggagcttgtacccacctgggcccccggccagcagcacggccggctttgatcggagcccctcttccctgtccgggctcgcctgccccagtccctgcttctgacccctgagtccggcctcccgagcctctgcctgcaccctgagcatccccaggacggctgggagggccaggtcttccgtgatgcagaagtgcctgagatggttcatgaaatgccctcattgttccccttctgctaaggccccgcgacgcctccctcctgctgtcccacacagggcccttgctgggtcacacaccaaacagcctcaaggaaaaattc

SEQ ID NO: 2360 - DNA, 501 bp, Homo sapiens
ttcatcattacaaatagactcatagctctttaatttttccatttaacactttaattttccataggcctagattttcaagaagtccaatatctctcacttgaagtgtcttttccctggagtagattgggagatttgagggatatctgtccaaagatgagacagtctgtttctagtttcccatccagcctgatggggcgtctacagtttttaccacaaggtgtcgctgttgaacagattctggtgcagtctagtgcatagctgtccacttctagagtgatcacttgctgggccaagttcctctccttaagtggtgtctcacattaaggttcccaaattacagactcattaattcaccctaataagctcatccaggcagtttaggtcttcaggggcttccagcctccaacacacattgggccaaaaccagcctgtaccaccagctccaagccctgtgttgaatctaggtcattggtccagatgccccttcattctgggcctgtg

SEQ ID NO: 2361 - DNA, 462 bp, Homo sapiens
catgtttgaaaccttttattaaacaggcaatgcattgtgcagtggttaaagacacagatgcctagtggaaaagtttaaaaattatttttggaaacagtctatgaattgatgaaccctgccgtgttccttcatctccttctcagagtggctgtctttaggaaaacagattgttttatagctgctcttggaaacggcatccctgttttgccatgaatgtcatgcctcgtagtaaacatgaaagaagacaggatccacaggcaagagagcgaccagagacatgggctgatctcagctggaagcacagatgtcccttctcctagaagggcttctcttctggcctttgctgggtgtcctatttatgtgtccaatttcatttctattttcttccttgtctgaggcttctttatcaagggaattcgaaaagacacattcgtacctttgggcacaggaactggttcctgg

SEQ ID NO: 2362 - DNA, 477 bp, Homo sapiens
aagttgtaaaaaaaattttgttatttataaatcaattacacaataaaataattatttttaaaagtcacaaatacaatcgttgtataaagtcattttggcatcaagtatctcttaaatatgttgcaaactattttccaaagagatgtggtccaaaccctctgaaggctttataattttgtattagataacaagtgaacaaaactgacaataaatactccaacaattattttttaaaatactaagtggcaaatgctattctaagtggcaaaacaatctattactcagactacctgaaaatttcactgaagtcatcaaaagttatacaaaatttgtatttacatgtttaaaatcctgattgcatttttctttaataataatacatacaaaaactcagagggttaataaagaaataattcaaagtcctaataagtcaacaaacagatttcattataagctgaacataaaagagacaccatt

SEQ ID NO: 2363 - DNA, 461 bp, Homo sapiens
aatttctaaacatttttatttcaaatctcttttcacccctccccaaaaagacatgggtaggtacagcaatcataaaaaggagatacaaacacaagagtcaaatgtctctcgcactgacacttacaaaaaactgggaattgtacatggggtttccaaacaggacctgcagcagctactaacgtccctttacgagagtcaaacatgcctattaatacagtatatacagacaccccattctggaactaatctacagggacatccctaaccccaccccctctatccccagaaaaataccaaaacacacccaaagtgcatttgttttgtttatatcaaaacctctttccctttccccatcccaccctcagacccctcccaccccatttaagattggcctgcaagtctattttaaccatttagtatttttttatagtttatgaaaataaattatacagcaactattt

SEQ ID NO: 2364 - DNA, 524 bp, Homo sapiens
gtgatgggggagaaaacacttcattgggttcaaagataatattccctatcataaatcagtggcataaacagccagtgggccaggtgggcccaccgtatgctagctgacaagggcagtcacacaccggtaagtgctgatacaggatgaggggtgcggagctgaggatgttgttctctttgatgaaggcctgaaaacttcccctggcccctgctgcccacctcagggctcctcaggacgaagggcatgaggacaggttcccactctggcccttcgctgggggacatggtttggtttccccatcgccaggctggccagctggggcccaagcactgaccgtccttccccaccttatcccatcagctgccctgcacaggagcagaaaacccatgcctcagagctacttcctaaggacactgcctctagaaggccctaaagtggcagagccggggatggcaggtgcagccctggccactagcacagcagttgccctcagatctgttagctgtgacccatagattggggga

SEQ ID NO: 2365 - DNA, 611 bp, Homo sapiens
ctaatgctatttattatcacaataaataattcactgcaaatgactgcatgaaaaatgtgggttccagagcaccatgtataaaatgatcccatttatgtagaactgtaaacatacatccacacactgacggacaggtacatatgcatgtttggggaggggtctggaatgatcacccaagtggacagggtgaggggtggtttcctgtattttttacaataagcatttatgacttttacaaaatcaccaaagctatcactttttccatttagaaaacacaaaattatttttaaatagagacttgacgtcatttgacacaccttggttttctctcggagagcacagatgccgcagacaagaggagcggacccgcctcccagactcctgcctgccccgtccctcccccgcaggtggcactggtgagccgggaaggtgctgccagccccaggatgcctcgcacagcccgggctggaaacccctgcccctgcttcctcgcacagtctgtcattctagaaggctctctccaaaccactcttccaaagagggtcatgccagggaacagcagcgaggtcattttccagtcatcccacaggaagccagtgagccccactccc

SEQ ID NO: 2366 - DNA, 601 bp, Homo sapiens
aggaccaaagaactttatatttattttaaatatcaaagtaacacaaagaactagttcaatatacagtacacttcctactcttcacagagaactgaaattttctataaagacatttatacttaggaaacatcagacaaccaaagtatgtataaaactcacaagatattttacacacagttcacaataattaattctgatattttagatttttctgtcattgcttttaaagtatccttaattaaaaacaaaaattattatttgagactgaaaacaagtgcaaaagcatttctactttaatatacactgtaaatccccataatcaaaacatttactacacaatgtggaacagctaaatgcccagttttgtattattttctggcagccacactcatcaattgtaatacagttttatcaatagggataagaagagttcaatcgttagaaggaataaaaattttgtaattacatcacagtacattgtccagctttaatgcaagcaggaataccaagcaaaaaaatacgcagtaacaatgagatgtgtacatcctcttcattcaatacatcttttagaatctccaacagcaatgcaagcattgattac

SEQ ID NO: 2367 - DNA, 686 bp, Homo sapiens
cactatttactgaaagtttaatgaaataaaaaatagaataataaaacaatcaaggaccaagggataatcaaaaccaagtacatttgaaaaagaacaaaatagaactttgctatactccataatgataaaataaaaatccaaaaataagatgtaacattcaaaaccttatatgcacttgactacagaaccactactatgtcaataaataactgacagaattagaaggagaatttcaaatttacaattgtagggtaacctttcaatattctgtatgagtgttagattctcatattacaagcaaagaaaaatgctaatggttttctaggatttgaacaagacaataagcaaatttgatctatgattaccttcatttgacacagaaaacatcccttctttttttcaaagcacacgttggacaatttcaaaacaaattaaccctggtttcagaaagttacagaaattaaggaacataactacaaaaagggagatataaagaatgacaagagaatgctgtgtaacttttacaaaaaattaaactcagtggaaaataattttcaaaaaaaagaagaaaatagacaagctgactaaacaaattatgattatgaaaataaggtaggcagttaaaaaatattttctacgtccttccacccaaatgctgccaagtccggtcagatattccaagtttt

SEQ ID NO: 2368 - DNA, 431 bp, Homo sapiens
aaaggcacagctttcccagtgtttgtgttccttgcttgcgccctgttttaatgttgtagttacaggtgtccagcagggaggaatgcagcccctgtgggcgcttgggggagctgctgggaatccaagttcaaggagcagctgttttctgttttctgttgccccacagcgccacctcctggccccttggtggtgatgattttgaagtcagcaggttctggtgggccgtgtgaactccagcagctctgggctgagctgtggaaacactgcgtcctttgaaataatacagcttcctgagcccaccccagtccctaaagactgcctctggggttgagattctgagatgcttgacagcatggcttttcccggtgttatgtgtcgtttctatccttaagcctggtaggggtggactggaggctggaccaagctccact

SEQ ID NO: 2369 - DNA, 476 bp, Homo sapiens
taaaggcaaagaaggtttttatttaagtgacaacatttgagagctaaaaaccagctcacatcaaaatcaagacccagttgtaaaaatcttttaactccataatgctgtttttgtcttgttagaaatctgatatcttacattagcgtttctaacggattttgtacaaggcagccataaggaatataataaacctttttcaccacagaaccatctgtcacagataatactgaaagttacacacttaggaacagtcagaccacagacaaggtcagactggctgccaccaccaagtaaacaactagaaaaggacagcggggtccaagggtgggggtccctgtgcacgagtcgccctcctctggcctgccccccctcgggtcacctgtttctcctttgccccaaagagggtggagtcaaatgcagattttcctcccaactgcctgttagtgtctcaacaaggagagcagagcccaggtcag

SEQ ID NO: 2370 - DNA, 419 bp, Homo sapiens
agatgccataacttcatttaatattgatagcagctcaatttaaattttgaaaaagcaaatacatttaataaaattggtgtgaattattacatattttgatggaactactgtacagaatgtatacatatataaatctatagatagaattatatacatttgagtatataccacatacatattttttccactcacatttttctctttagtaaaacaaagcagttttactgtacacagaagtgcaatgctacattaagtcctgagtaatttaaggtatcattaataaactgctataaattctagttttccagccaaagatccaatagattctgtaacaaaaaatgtgaataatacttaaaaatatgcatttagctttgcgttcattttgtgcttagcagaaaaagctcaagaatgcacagtag

SEQ ID NO: 2371 - DNA, 958 bp, Homo sapiens
aaaaaataaaaatcatttatttaaacaaaaatatacacacagtgtacaatgaatatggtttacacagaacaataaaacaaaaatgatatctcttaaatgccaacataaaatgatctatttatgcctagaaaaaatttctaggaatacacattattgattcatctaaaatacatatataacataaaaagaaaacaaatgccaacctttcagatgagtaccacaaaaacctaaaagttaaatgttagattaaataaaattataaaatatccacacgagaagtatgtgtatacaaagtattgtatgtatgcagtgaaatgagagtgcccatacagttatatgcaaacttttgaaagtttcatagttgtttaacaaaatatttttaatgttgatagtgacataaaaacatcacaagaattatctagataatatagcaatattgccaaaatttgagtcaatgttacctgtgagtgcaataggtcatcattgatcgcgtcctttcatgacctggcggtaatttagatgattgaaggaatattatgaatgtatttacactgtgagtgtgaaagggcaacatttttcttcctaaagaactgtatttactaaaatatattttttttggcaagatgtgatttatcaggcaacatcacttgtattaggtcttccttcccttggtactcactctctgtgggtaccatactcaattgtaaatcttttaaaaatttaaaattctaagtatgcatgcaatctgtaaaaattccaatttaggatagctaaattcattacatttttcttttttgcttatattaccttactattttacctgtctccttgttattaatagcaagacatatgttccttttagaaatgtttgattctcttatttgcttagaaatagaattcaatgagtgattaatgtacaccatgattcagaaaaacaaatgcaaatttccatacatta

SEQ ID NO: 2372 - DNA, 531 bp, Homo sapiens
aacagtgatatacataattcaatttttattatcaccagtctttatcaatttagctgttctcctattgttcaagaaatgttatttggacaagttttccatagggcaacttgacttcctctttattcatttaaaagttgttgtctccttcaaagatatttagaggttgatctggtgagccctggaagtctaaagtcattttgtggcttcagaggcaggaagaactcccaacagcgatgtgtcgctagcatcttcacaaccatggttgggggtgtcatctgaggttcttgtcccatgtgggtcctctctcttgaggcaggtctccatctcatggaataaattctcctcgagagaacccctccttctggttgaaactctgaggggcagatgtttttgtttctgaactcggcaccacgtgagaaatagaataaacagaaccaggagaaggagcccaaagatactggataaaataagtgctaaatgacctgaggaggcattcagtgatttcagcgactgtccagagcacctcacgcc

SEQ ID NO: 2373 - DNA, 615 bp, Homo sapiens
ctaagatcccttctttatccacatcacttcagccaacaatctgattggtatttccaagacaacagagcagtatttcaaactcatgaatgggattttaatgtgctgtatggaatttgaagcctcaaacttaaggaactttccacctggaaagcattcttaagtaacatcaatgaactgtcctccctaaaacctagacacagtatcactgtggaaacagagtaatagttctggaatcgattgaggattaggttagaagcgcccacaccaggaaaagcttccgggaaacggttttaggacagaatcaaggcacacctgtggaacctctttctgcatctgtcaaatggggacgctgtgtctcctctcttcttaggagaggattaaatgagccagagtgggctagcacagtgcctggcatgagactacagtttcactgggtgctatactcactacctgggtgacaggatcattcgcatcccaagctcagcatcacacaatatacccatgtaacaaacctgcgcacgacctcctaaatctaaagtaaaagttgcaattaaaaaaaaaaaagagaaaaagactatactttcaacaaatgccaactccttccctcattctttc

SEQ ID NO: 2374 - DNA, 476 bp, Homo sapiens
cctaagaatgacaacttttattaatttaaaatatatatttgacaattataatttgggacctatataaaacaaaaatataatcacaactattttatggaaaaatatttattcatatagagtgaaaatacctccaaacttagttatttgtagctgtcagatgagaagtatttcctaattacacccattcataaacactcattttatcacttcaaagagcaccagtgtattttttcaacaaaccagaaagtaagaaggtaggggcttatttcatgtaacagtgctattatgataaggcaccactaggtatatgaaaaagccaaagtatttccaaatcatgtgtttttgttactggtgtcttaaccattagacaggatggttagaaaaaagctgctaacattattaatgaaccacattatagcccctttcccaccattctgtgcttttagttttacttataacagaaatgaaaacaacaa

SEQ ID NO: 2375 - DNA, 575 bp, Homo sapiens
aagtattacatcaatcatttattctgattttactgaatgacagtaaagagaaaccatttacagacatgaagctcgaaaatgttctacctcccaatgcactagtatttcagagacttggaatatatttggagatgtggaaaatgattacactttagtaacactgagtaacaattttaggccaagtatactacactcatattttttttgaagtgagacattagtccaccctagtactgcatacagacacactgagtaataaatatccaatctgtgatcatctttataaagggcaatttattcgttgctttccccttaccccattcgccctagagtggcttcgtttcactttgccctaccccttctagcaggtagtaaacagtcctggccagtgatgccatctggcggttagttcagaaattgtttaaccaacacaccttccaatcaggatcttaccatcgggaccctctccaaaaccacactcccctttcttccagtttttgcccatttaccttagtaaaatcgggttttcttctttcctgccctgtttatccaactgaatgaaaaacgtattttat

SEQ ID NO: 2376 - DNA, 710 bp, Homo sapiens
cagatttaaaaaacatttattttaataagactattgcaaacacattaaaaaaactaaatagtaatattacaaaatctatatacttgcacatttagtatttgtcaatgtgccagaggttttcttcatgaaatttgacttctttgaagtgaaggcttttttccatcatctcttatagctctgactgaataagtcttaatgctttcttcatgttttctatcaataggggtaaatcccgaggctcatatgtgtacaatctgttagagtatcttccagctatgtcagctctaactgttaaagaagggtctacaaacatgattctaggcacatattgcccatcaggtgataaattcttatcagtggtttcatgcataaggtttagcatgatgaacttattctgagccatttcttgtatttcttcattttgggcaaatactttctttagtgcttgagagtattgacaatcctccaggtgatgaataaccattaatggcttcttacttttttgagcataaaagagaccttcttcataagtttgtacccaagtgatgtcatctccccatcctcttgagagtgtctgaggaggcctcttttccttttttattgcaatggcaaggttggaagaaactgtgacgagtaagaggcagagacccaaagctgagtgtagcatcatgtcttctagagactctctcagaagaagctgacttggccag

SEQ ID NO: 2377 - DNA, 495 bp, Homo sapiens
tccatttaaacatttttataatttgtttcattttcaaggcacaaagagtttatgtcaatcattttaatgtctaagaatacaaagttagcactagtaacatctggtagtctaatcatttatcatgcttaaatgtaacattacaaaactacattttaaaatctgccccctaaccagatgtgaaacaacgtggacaagggtgacatgtgctagacccaatctccaaaaacgtatggttgacaaagacagctgactgctggggtaaaactgcagcagtcataatcgaagagcgaaagaggccactctattaaagactttgtttcttttgctagacatttttcacctaatcccaggatagtttctgttaatgcatcttactctctttcaaacgaatcgtccctagagcaggtgtacacattaaaaatgagctttatagcatcaaacacataccacaaccaactctacaaggagggttttctgtaagatgtgtacgactgt

SEQ ID NO: 2378 - DNA, 738 bp, Homo sapiens
agactgaattgaatgtctttaatttcacacaatgaataacatatgaataggattaactttttttttttaatagttaagtgctctatactgtgctaacctgatctggtagcggaaaagactgagctttcttttagaaaaaaatgtttaaaacccaacatctaagaccatggaggagcatgacagtaagcatgctagatgtatctacgcctcaaataacagcaagtccatgttcattttaaatgtacaaaaatgctttatgaataaaaactgttacaaaaagaacatttcaaacaatgtacaattttcttgcctctatattcaataaaatacaaatacattttttgttctaaaatatgtttacatacaatcaaagtagaacatgcaaattacactttaaaaaaggcttttaaaaaccacttatgaatacaaactaaaaattagccagcacgacttgtaagacaatcttgtgccccattttttcttttgaaatatatatgtacatatttaacacatcatgtgcatttattattatttaagaaatagattttttttaaaaaaaggaagaaaaagaaagacaccaatctagggtggaaccgcccttccacgttgaccagttggcagctcctttcaatttcccccctttagtgtttattagacctgggcaagtgggcaatagatatccaggaagtttcttccttggttgatatgtgcttctaagactgttccccaaatgactga

SEQ ID NO: 2379 - DNA, 761 bp, Homo sapiens
accaaaagtaaaaaaaatttattttatagagtggttgatttttgtaatacatcaaaaactgtgatgttatacacttccctattctcattgcttatctcatatcagtggttgaagtttctcccaaataatttagtttacatttaaagtggcaatacagattttacttaatggacttaagttataattagaaaccagttttatatacagaaaatccataaatatagaacttttattcctattttatctttaggctatgcaaaaaatggactaaaaatttttcatttgggtctttgtaataaacatgtaaatacatatttacaatggagatgcttcctgatagaaagtaaacagaagtaattttggtcttcactagaatccatcatatctatttttgaagatgatgtaatacatcatgtttactcaaaatttgattccttttatacacataatttaaataattactccacttttaccattaatgtttcattctgtatttaaatttccttcaagaaagattccttgatccagtagtagggaactctgtttctgtacagttaatgtgtaatttttatccttctggcaatattacaaatactgagtcatttaatcttcattgtttattctccaggggtaattcttgagttatctcacatgatgtaagtaccatctttgcagtatttcatggattccatttgttttgtcatagccagaacatcatgaaatccagtacttaggccagacatatgttgaaagtatgcctc

SEQ ID NO: 2380 - DNA, 420 bp, Homo sapiens
ttggtccgggttagctttattggagcctcctagcaggccaggtgtttcaggcaccagtagtgctgcaggcacgggggcctgtggtgtggccagctgcaggtgatctcggtggtggactccgaagtgtactccagagaggtcccggaatggcaggggaccagctcgggcactgaggcgctgctggcaggctgtttcgacgattccttctggcgctgtccgctggtcttgggggctgcgtcctccggcttgccagaggacttgctggggggctgcgtggggatgttgctgctgctgggagactggaccatgggtgagaccgggctggaggtgacgttgggtggctgcaggggccccgaggacgggagggctgactgggaggggctggaggaagtaccaggcggctgggtgtgttgccgagac

SEQ ID NO: 2381 - DNA, 420 bp, Homo sapiens
tatgcaaatagttctttttattattaacattagggtatgtcaaattttaaaatatttacacttaaagacaaaacatttccacaattattacaattggtttcactaaatcagaagtgactacacattatctctacttttataccagaaaacaaaatgaagaaatcaacaaaatataattactaaaactccactgtggatcaggataaaatgtgtccaatattaactcacactttcccaataagtataaaaatgaatataacattgcttggacaacttgtttcaacagcgaatcctctattactatttgttcaataacatatataaattcaaaactggcaggtatgaaaaaaggttactttgttttttgcagatactgtacttgtaaaataaagccaaataaagcatatgtcacacatacca

SEQ ID NO: 2382 - DNA, 854 bp, Homo sapiens
gaaaaataaatgaaaaaaattttattgagtattactttatacatgcaaattgaaagtgaatctatattaagttgactattccacaataaaaacctatgaaatgggaatgatcaaagctaacacaatactaatgtgttcaataaattatccagatgtttttccacaaatatttggattacctgaattagctgattcttcagcaaaagttaaattttagctttaatatggtagcagcaggatgctacttaaatttagaagaaaaacataagaataaaaaccctgaatagcatagccaaatcttccaagaaataagttcaccaaaaaagtagcatacacctatttggtatccagaggaggaaacaaaacacaggcacttaatcaacatccaccaagtgatcatcactaacattctattattaccagagtaactgtcgatatgtgaactgtagattagaacagacttacatatctaaaaacaaaccagtaatcaataatatatacagaaatactaacttgaagtcacatttaaataccatcaacagtttggtgtatctgatataactgaattcatttcatcactgctataaattccttaaaagtgttcttttcctaattaacattatctttaaaaaatggtagatatttcccagtatgcatcagttttttcactccaccattcagtaaatgttgtagcaaattaaatagaacctattaactagatctaaaaacagtggctgaatacttaacacaaagaagtacttttgagtaaactattcagattagacaggctaatgctaagactgcattttgtgctactgacatgcactatatagatcgtacactactagatggaa

SEQ ID NO: 2383 - DNA, 473 bp, Homo sapiens
cttaaaatgctgatgtttaatgatctacactacatgattaggctcaagatgtgtggattttctaaaacactgatctgagatctcaaacacatgcaaaataggataacaaacaagtccaaagctgctcagccactgaagagtcctcaggagagtagtgctgatgtccacggaatgtgggagcagcacatggacaagcctgtgagtgggtttcactcagtggaatccctccaagcaggtcttgttcaggaggctgaactgagtcatccagggcctggtgctgatggtgaagaagcaggtgaaagtattgttcagctctgtgctttcttggaaatggcagttgtcaatgtcgtcttcaaatttcccacacctagttctccccagcagtagctccattgagaatacagtcttggactccacctgctccttccaggaattcaagatgtgccccagtctgtaggcatagtagtccttgc

SEQ ID NO: 2384 - DNA, 640 bp, Homo sapiens
actgtgaaattctaaaatcatatttattcaccaattcacagaaagtgtcataacgaccaccaacatgaatcagtttgtaggcatttacaagccacagctgaaaataaaaatctgtctgtgttgaataggcatttaacaaattacttgaaaactgcaagaatcataattattataaatttaaagtttgtgattcaaacatgggtaagatcacagtcatggggagaagcccaacagattcctgtgatgatccttattttcttcctatatctttatatacatagagactctcagcgcccctcactctgtgtcagtctgaattggatatgacagctcagttaggcctgagagaggattctatgaaaaggagtggggaggggaaaggacattttctctgaccctctgtggctgggcaaccttgttgactgagaagacagtgcgctcttctgaaattagattcaattttctataaattcatacagtccttctaatgagatactccaaagtctgcattgtttcacactcatacacaatagtatatttatcaaataaacacattttctagactaaaaagattcattctttgaggcagcttgaagagctcagaagtctgatacatgtcaggtacacactggtccaccgc

SEQ ID NO: 2385 - DNA, 803 bp, Homo sapiens
ttgctcctctgtccccagcaccccttatttcttaagcagcaccaccagtccccagaggacaagagcagctatatctcatccacctgtgcatttctgcaccagcgatgcaaaaaacaccctgggtgggccacagagaaaaccgtaactatggatacccaaggggcagagcagccagctggacctgctctgtaattcacttacttaccagagggtggttcaagtcaaacaaacaaaaccaaagacagttgcaacccatggtggatccaaaggtacagtatcaaaatcatggaactcttgcccaaagaaaagactgcaaatagtcatctggtatatcttgtggaaagatgataggtttatagtgactcaaaatattttagaaaaatttctgtagtgtcaagttctttcaaacttaaaattttaaccccagaggattttcgctgaataaatgagaattggctctatttcttctacttctggatagcccgagtaaaaatactaataatttctagattttagtggggaactacaattattaggacccatggatattgctgcagttcaaatacaatacagtaattacaaaatatagaccatctctttacaaatacaaattatagtatattacaagtcatgtacagtaaatctataattttaaacaaactagtgtatctaagtttacctggttgcgagtgcattattattccagtttacagttgcccttagcgtgacagtcagaaaccgaccatcggagtgatattctcttatgtaaatggcgtcacatcacagaaaaccttatttatgag

SEQ ID NO: 2386 - DNA, 545 bp, Homo sapiens
actttgagaagccatttattttgcagccttcagtccaaaaaaagtcaacattttcagaatttttttatataagttgtaggtcatttttataacaataaactttctattatctatttatctctcacatacatttcatgtatcctgagtattatgttacaacaatctgctcttgatagtaatgttcctgatagattaaaagattgagaaatacttgaagaacgatcaaagatacaatgagcatggtatacttttgggttaaaatgtattctttgataactgatgtcatatagatccctaagtaaatcaaatatttaatttcctacatctgtctaccttagttaactggcccattcctataagcttaacaaaaactcactttacaattatttaaaaaaaaaatttaagagatttttagaagttaaatggaaagatacttttggacattacaatatttttaatgagttattattttaaaattagagatttcacataaaaaccaggattctttgttttctctttaaaaaaacagaggctcttgcaacagg

SEQ ID NO: 2387 - DNA, 437 bp, Homo sapiens
ggaccaagaccatatatcactttaataacagaactccttggaccagttcacagaactgtcatttaaaaccaatgtcctagaccaactccaaccttcttgttttccagtgtacccaccccacacagggccagccacagccaggtgagaacaggaaggggagtggagagggagagtggagagggtcctgactcccataggcttcatctgggctggcccagccttgaccccatctgcccaggagcctctcagccatggagtcctctagggaggcacttagcccacctagagcacaggaaaaaggtgggacggggggcacctcccagcaccctcccaaaagactcacacaggggcagggaggggagagggcagaagggcaggcttcctgctgcttctagcagcctcttcatctccagctcctacctctctcctccccctca

SEQ ID NO: 2388 - DNA, 703 bp, Homo sapiens
agaagggagcacctttatttggaaaacagtaatttcaaaatcatctcccgaactcagaatcgatgggtctgggtagataccctaagtaaacaggtgaaatcttcattacttgttcacttattaagtaaaattttaaattaaccgattatgtacaggagtgtttttcacatttcctgataagaatcacttggaatgccctgtaaacacagcttcactggagattaatcctatcaaattgattcagcaagtccgagatgggccagtaatttgtggagatttttatttttacaaatgcttcctgatgatgaccaaatctaagaaaatttggtaaacaacggaaagttatctggaacataactttcagttttctctgcagtttttaagtgctgaactactgatcatcctagagataacccactgaaaagtcttctctaatccagttttacaaaaggaaagtctttttaacatttggtttgataaaatgttttccgaagaaatactttacttgcctgttttcatttctggcccacccgttctacttcacgttttcttgaagggttcatcttctatgagttgaggcatagcaatctaatcatttttaaaataaatggtttcttttttttttttttttttttgagacggagtctcgctgttgcccaggagtacagtggcgcaatctcagctcactgtaagctccgcctcc

SEQ ID NO: 2389 - DNA, 792 bp, Homo sapiens
ccccttgtctccatatttttattccggtacctggactggactatatactctcaattaaaaaaaaaaaaaactaaataaaaataattctcaatgcagagttcttcaaagaattcctaataattcacacgttccagcttcagttatcaccgagaactggttaggttccttccacactgggaaactgcatcaaggaaaagagctgggcaaagtcagattttcatgccagccggactccttcgcacccactttcagggagcctcccgccagcctccagacctggtcagatgatatgaccttagctccacacgtcctcagggtgtcggtgtctggggctcccagccccaggcaggccgggcggcagctacagcctgagctcgcggtcgggcttcatgctgaagggctccagccgctcgccctcgggcagcatgctgttgagcctgtccagcaggggcacagtctggtcgatgcccatctgtatgcggcggaggatggcggacatctcgttcactttctggatctgctcggcatacttggcgtatcttttctggcgctcctgcatgaagctgaacagagtttctacagacagatccatctctttgattcgtttaaccaaagcattctggtcaaaagcaacggcctctgcacactgatgcaggtgatcttgatatcggaggcagagctgcaacacctgctgagagtccagtttctccaatttggcatttgttggggaagtctggccactcaatagccctttcaaaaggggctggaaggttggaatctcttgcaacttga

SEQ ID NO: 2390 - DNA, 499 bp, Homo sapiens
gcacatagaaacaagacatccatgtgtacagtatcaaaaaatatataccaaggttactggtattgcagttcgtggaaggggaagagaggggagaaaatgaaatcaaccgaaatactggatggaggggaagaaaggtcaaaagaaaatagtttgtctgatatagaatataacatgatctagaggaaactccataaatctaggtttttatatttcaatatataaatacctacaaataaatatatatatagcagcccgaaggggggtggtcgggccttttgagctcaaacaatacatttcaataataacaccacgtacaaacgggagtagagtcagcacttgacaagttagcacggttaaaatataatactagaactctgaggccgggcgcagagctgccctgtccgttccgggggtccatctccagcggggaagggcaggagagggcgagcccgccggcaccgcgtggaaggggcctccgcccaggtctgacagccgccgc

SEQ ID NO: 2391 - DNA, 743 bp, Homo sapiens
ctgtacgtatgttttatttgaacatccacatttcttagcttagagacaattatattccgtacacttttcttctctctctcttacaatatttagactggccaaaaaccagggaaaatgtccttggactgcagtcattataaaattttacttaatgcttatgaaagcactcatgtgaaaagcttcagcatgaagtgtaatcaccacattcagtttcaaagttcaaatgcccattcctatgatgggtaaacacctaccatagcgcaaagaaggagagtgattgtgggtaatgacagaggaggaaaagtgaagggggtaacagcttctcccagaggagggggtggtccctgttccatgcccatcttgtctccttaaacaggaacagccaacaggcctaccagtccttgtactctatgcagctacttcccctgctggaaatgagcagctgccttcttctccctaaggtttgtcctcttttatctgattcttggaaacgtttttttaagttttgccaggttctttgttctttcatgaatgaactgatggaaattttctatggaagttacttacctcacttaagaagcacacagcacgtctcgcctataatcctagcactttgggagccaaggcggggggattgtctgagctcaggagatcaagaccagcctgagcaacacatgtgaaaccccatctccactaaaatacaaaaagccaggtgtgcatgcgcctataatcccagctactca

SEQ ID NO: 2392 - DNA, 483 bp, Homo sapiens
aagttttcttattctttattagtttaaaggaagctagaacctaataacaatacgccacatacggttcagaaccaaacaaaagctgcttagttatttattttgcatttgcattttgtaggaagtgagaaaaaaacagctctattgggactcaagtttattttcaattaaaatccccataaattaggaaatgtcttataaaacggagaaattggaaaaaaatgttattcagaaaaaaactttcttgagtgtgcttgtttcctgtagcaccttggattttgtgatcagtcttttaaagatattttttaaaaaattcaacctctgtcttcacatttaggacagggcataacagtgtcttgtcctttcatgcaaataagaggaaaaatttatacttgcttagtttcgagcattgaaagcactcgcccctaattctgccatttgctcatgtcccacatgaataaaaggatacagcttagaaaccagggc

SEQ ID NO: 2393 - DNA, 837 bp, Homo sapiens
cagttagatagttcctacactgtggttatttaccagactagaatcctctctgggaagtgtttaatcctgcatcaaatacagacaggaaagcattggcttcgagagaatcacagttcactgtaaaggcaagccggtgttcgaaaaggaccattaattcagaaggacccaaaactctggaaaggagaagtcatgatcactgctgtttcaggaacaaccttggtaacttgccagttacgctggtggtggagagaatggaacagctggaagggagacttcttagcgcgctcggcataggcacagacttcactgcttcagaggacacgcagtgcagacgagagtcccaagcttcccagctgcaccaggtccacatggcacttgaaacaggctgcctaagaggccacaacgcccaagcatgctcctttgctcagagacccaggacctcagctgggtggctgtggactcagggccacccttccccatcttccagtgagatgcccagcacagacttgtgggggattctgcactcttgcagagatttggtgaggtcagaaaatcgcctcctgggcacctccattgtttcaatgctgcagtgtcggtaggaggttttgtttttctgttcggccacagcaacaatggtttgcaaatcatctgttggccggaaatggcgtacaaacctttggcctgttggtgatctaacagcaagcagcaaccttggttcttggtccgatggttcctccagatttccagccctggaagagccctgtttcttggttcggacgatgaatttcctctccacggcacaagctcgagctctggaatcttcttcacttgtcttca

SEQ ID NO: 2394 - DNA, 465 bp, Homo sapiens
gggaaggaatgtacttttattgaaaatgaaaaaatataaaagtaccatcttcaaagagcatctcacaaacactgtacagcaggtgaagcattgcagtaacatacattgaaacatacagagtcgagttatacaggactagccatctaacaggtcatctggtctccgacggttgtttaacgacacacagtagaaatagagaatagaacccatatctgtttccagagtccaaagtagtatatcaggctgacagcactcaatcagtgagggctcctgaggttgcaatgattctgcaacggagtagattctctaggaaaaaagaccttgctgctaaggaaagagaattaaaaacaaaacaaaacgaaaagctccccaaagaggtactctgctcaaaatggctggtgctactggtgcactaagttgtgaggaattacctctgctcgggacagaataaaaaatcctaggcct

SEQ ID NO: 2395 - DNA, 736 bp, Homo sapiens
aacttttaatatatgatttttattgaacatgttcacctttacattattacaaacattttacaaataaaaagtttttgtaaaaaaaaaaaaaaaaaaggaaacatttcctgaattatcactggatagttgaaacaaagaaataaaatatataaatatgaaggtcattctccaagtattagaacagaatacggatggaatcacttcagtaaagttattcataaacatttgcatggttacccacatactgtatcaccttccaaaaaatcaaacacatgagaggaaggggaacctcaaatgagatgtcttttctccatgggatttggtcaacgcatatcagtaagataatttctttgctatatacacaacataaacatttgaaaatgcagaatacattgtgtaaattaaaaattttgtcagctttgttgtatggggagtaactacacagaccacccacacaaacatttaaaatatactgtgtatatattatcttacaaaaatcgcatgtgtaagggaataaggcctttatttccagagcatcttaacataggattaatatgggtatattcatcttttatattttagacttcaaattctttaacatctcagctattaacattatgcgtagtacctaagacaacatatgagtagtggcataacacaatttcaactacagtgcttggttgcattcacatgacgtaccatctagaactgaccaaacagaatttcagaactgccc

SEQ ID NO: 2396 - DNA, 399 bp, Homo sapiens
gatgtttgtcatttttatttgcaatactttaggtccaagtttcaaactgcaatatttttacactcaagacacagtcatgcacaatccatatttcaattttctattgcttcaaccacaatttaaaataacaatattgaaaacaaaaatccttaaaaagattggatgctgaggtcagaaggatggaaccataccatcagcaggtctacaaaagaaataacttacttaaaaatcaaacaaacaaaaagaccataaatacctttaatccaaagttacagaagaatttcactacacatggtttacagataacacattctgacaaaagtaatgctcagccaaatgagatacaattctgataaacaatgaaaacgtggatccttctcaacttgttttgtgtagatg

SEQ ID NO: 2397 - DNA, 1372 bp, Homo sapiens
ttggacatttcaggcctccactggcagttgctttcactgtacaaatgtaaagtgtggaaaagggtaaggacctagaaaaagttatacaaaaaatatgtgccattgtcaggtgcaaaacctggcgactactctgaaccaaattaagtataatatccttcaaaataaatgagaatatataaataagctaaaatagaatccacacaggcttcatagaaactttgaaagcattacacattggtaaggccccaggataggaagaaaataacctaacatgttcaaaagggcaaggaaaaacctccctacactgggaagtttgttactaaataaacttttctaaaatggaagcacaataatgatcagctcttggaatttttattgcttaaaggcacgtctagtatacacgaaatactcttttaacattgctggtcttttggaaacattcttagttttaaaacttgaacctttatgcactgagtgcctcagggtgaaaagaaaaacttgactttgcatttcctaagctgtaagtcagcagctttttggctcattcatacctatagatgtatgtgtacacacacacaaacacacacacacagacacatacacacccctatatccttggttagtttagcttggattaacaaaggtacaatgcccaatggctttcatctgtcttcactggaagagtcactgtaatctgagtctctgcatgggaaacatcaccattagtgttagatgctctcccgacatgcatagctacaaagggttttcttagattataatctatgtgcttgttactctcagaattaatccagcataactaaattttgggccttgaactcctttggtcacttggatctgtgccaactccaaataaaatcacaaccatttcaattattgttcagaacatttgcctcctcccttgctctggtgatacattttctgctgtctcagagctcagaatgtcagtttgtaaagcatgatttaaaactctctcagtatgtcattgtagcagtccatttttatttttactgcaggcaacatgagattccttaggggtgagcctactgcacattcaccaagactaagtggacaatagcactgtgctcacttttccctataacacatctcaattattgtgcagagacttgatcctatgtactctatgtttaaagaatgtaattctttatgtgcttgagcatcaatgtttttacatatggtcagctttttccctagaaccttggcatgtaaggcgaaagagcaacacttcctgaaacaagttctgagttgctttatattaaatagttgccctaaagcaccgtacattagacaaaggagggtggcatctgcatatttgtcattgagacaccacaaa

SEQ ID NO: 2398 - DNA, 532 bp, Homo sapiens
aaaaatttttaaatgtttaatcacaagtcagtagcatgacatcattagtagagtagagtctgctgacattacaatctattgatctccccagagttaccaaaagtagttcacaatagttaggcttccttctgtccatagttcagggcatattcaaagtctctaaagctgacgtgaccatctgaatctcgatctacttccctgaatacctcaagaacagtcctttccggtaatttgggagccacctgcctaaatgcttttttgaaatcttccaaagttaaaaatccacgatagtaggtgtcaaaggctgtgaagatgtgtcttacttcgttccgatatcgttgagcttccttctttttcctgacaatatttaaaaacccctcgagtaatataccagaagtatttggatttattgaagacatcacagaatccacttctatcttggagggcttgtacccaaacagcattacaacagcagttttaaagtcctctctgctgagatatcctttgtgatcttcatcacatgctttaaata

SEQ ID NO: 2399 - DNA, 532 bp, Homo sapiens
cttaataaaaaaaaataatttattgtcaacaaaggtgatatatacaacaggaaaacagatgtaaatgagaacgggagtgaatggggtgcccaggcccagcttcaggcctctgcagggttgggacaggaagaggtaatggaggcctcctggtttagaagcctgaacaagtggggaggagaggtgtcccccgaggtagtgggactcagttcaaacccccttatgaccactcttgtgtaaggcactgtgccaagggagaatggtggggagcagggggagggtgggaggaggtcatgggggacaaacagaggtgggggtcagcgaaggactggggtaggtgttctccacaggcccagtgccctactgcacaacagcctcagccaccctcgccgacctcaggcctggccaggaacagacactttccagtgccccgaaataacagtggatgctgccccagccccctcctgccctggcacctgtttctactctctccaccaggtgggtgagccaggcagctctgagttataagccactg

SEQ ID NO: 2400 - DNA, 472 bp, Homo sapiens
gtacttttattgaaaaggtacatttaaaaaaatacacagacattttaccatttacaggttgcagatatagatgctctaaaagagtccactctattttgttgttctatgataactcttgcccctgatatcacaaacattccagtcttgttgatatcggcttagaaaggggggcatgggagcatgacctgcaatatattcagcgaacagaaagacaaattgttcaattataaatttttttatcttctgtacattattgcattagggagccacaaaattatgtagcatcattacaaatgaaaacaggttaaaaatgaagaagatacttatatagaaatacatggattcattgtcttcttgcagaatgcacaagaggtgcaaaaatgtgcaatttaggaagctctttttctgtttgtatacgtttgcttagcaacacaaaccagtgaggaagctacaaaataagttaaacaaaaat

SEQ ID NO: 2401 - DNA, 554 bp, Homo sapiens
catttagtattttaataataataaaaaagacatacaaaatccaaacatttctttttacaattcagatacatatttttccccaagtgcaaaatactctatgaactgcatcatttgctgtttattgtcgattgtataggagatgcttactaaattggcagcagtggaaggcagatataaatacaatattttgaaatttcttctgcatttaacaaaaagcctcccacatggcgatgattattctgaaacttgagttcagctcacacagaagtataaagttttcagtttgttcaaactgctacaacctgtggtgtctaaaaaagctgatgacaactgggggttctattccttctaatcatatatttccttgtacaaataatggcacaaggatagggtgtgctacttttgagacgggtcaaatgtaaaaatatccttgtgttgttcgctcccacttttattgtgcttaagaaagaaacctggagggttaacattttctgcttatgctcagttatactttgtcttggtaccccttgtttgtggctgtaatattgaggtta

SEQ ID NO: 2402 - DNA, 469 bp, Homo sapiens
ttgaatgtatatatttattataatctccaaaataatttcacttggtacaactgcttcttaaaaccatatcaatatcaggctcagaatttaattacaaccaagcaattcacaaaaacactgagcaacaaaacatgcttaatatttctttgagaaagacccttcaaatatgtgtacagcatcactgggagttacacaaaactgttacaaggtgaccattaagtgccccaattctgcacttctgacatacatgaatggctaatgtaaccacgtttgggaatctttttacatctcaaaataaagctttctgatgcaacttgccatccttttaaattttaaaggatattcttggtaattccttaggaaagtaaaactacacacactttcagagaaacaataagctgcttagatttttaaaattttttatattatacacttcaattatgggttatttattaaagacttcaaaaaa

SEQ ID NO: 2403 - DNA, 837 bp, Homo sapiens
aaattttatgcatgtatacacactttattaaatttgcattctaagatatacacaaggccagcatttcacaaaacttcctattattccaaaagcagtaatcatgaaacagtgattatataagtcaatcaagcaaaaaacattatctatagggttgtatcatatcatctcttatacctgttttcaaatagaagcctgaaatatatgatatatattagaataggaagagagaattttactttataacaatcgcttttcaaatattagactttatataaaaataaaggggtcttaacaaagttcatctgtgagttagcatatctctttatttcaaaacaatccctgcaaaaacttaactttccagtccatttaaacaacaaaaactaaaaatgaagcttggtttaaataataaagtgaatcatcttgtctcctagttctcacaccattggaacaacttccatttcctgacctaattctatcccaccattgaatttcaaaaattaatgtaaataccatcatatttcagttatttcttaacagtgttaagttcgagcctaaaaatgatggccaagtgtccctttaaggcaaagaagacagtaggtggataaatatcctgaaagacaaaaccatctattatcattatagaggcagaacattttgacatgatcttttacaaacagaatagatacactgcataccatcgaagaattttttctttataatggcatactaggggacaagcttcataatagatttatgttacgtttgaagaagtagagacttttcccagatgagagcaatacaagaaataaagccattaatggctgttatggttacaat

SEQ ID NO: 2404 - DNA, 625 bp, Homo sapiens
agaatttaatatatgtttatttgtgtagtaggaacattcaggtatataaataaggtaaatgctttccaacgtacagtatatcatgttcttacattgcgtggaaaaagaacctacatgtattgttcaacatggatcacgagtgcacagagagagagatcagctgcatttagtgaaacgccaagttgggaaaatggcacagcagtagcgcacaggcacacagctatctggggaggctgtggggactgtcacgtggactctacacaccgagaactgcttcaaggtcgcctgtgtctgagtgcgggtaaagtgaatatcaacacccaggctatcagggtgagacaactgaattccatcatgtccatccactttacaaaggggtgggaggcaccatggagaaactgaccagaaatgctctgccctgtcacagaggagacagagccagggcagacacagggctgacctctgggaggcacagacactggcagtgatgggtcccatgggatgcctggcactcccagcacagacagctccccaaagcaggtggggaggccctttctgtgtttgggaactttttagttaaacaaatcctcagaatcgaattaagaaggatgtccacagctcgatc

SEQ ID NO: 2405 - DNA, 465 bp, Homo sapiens
cctttttggtctagaatcatagtttttgtttgagtcatctccaccatgccttccatgctgcctgtcttctcggagggggtttttggttgtaattcctttcattttgctctgctcaaatgtccttcctatttggtcaggagcccttggccccctctccacccttgggctggggcccaagccctcttgccagtcccttctctcttcaggaaataaacatggacaaactcagaggtagggtaagggcagggagtcgttcagcggagatgcttacattccggtgaggttgggtagacgaggtgccaggccccatcgtgccggggtgggaggggcggctacttcaccactgcccggacaaggcacccagaggcccctgcaatggccgagtctctgctgcctccgtcgcccagcccaacagtttcatttcccgggtgggagaagggagacaaggaaaaaagagaacgctga

SEQ ID NO: 2406 - DNA, 884 bp, Homo sapiens
aatgttaacccaatactttaatatgaacgttatgatcagtaggtagtatcttagatgatacatttaatcacagacaaaacaaaaacctatctgtatatgatattaagaggagcacagaattggataaagtagggtttatcttagtcggagaccaaatggttttgatatgtggttcctagaccagcagcatcagtagcaactggaaatgtgagatgaacattctgaaacacacatctggtcaagaaccactgttttaatagctttaaccacaaaacatccacattgttccctaaagttatgctaagagtaaaacgagtaactggttaactgcccatgatacatcaatttaatggaaaattatgcaactgtcaacaagaataagcatatctatatgtattgatataaaacaatctctaatatagtgttaagtgaaataagcaatatgcagaacttaaaaatactttttagccgggcacggtggctcacgcctgtaatcccagcactgggaagccaaggcaggcagactgcttgagcccaggagttcaagaccaacctgaatgacatggtgagaccctgtctctatgaaaaacacaaaaactagctgggcattggtggtgtgcgcctgtaatcccagctactcaggaggctgagatgggaggatcacttgggcccaggaggcggaggttgcagtgagccaagactacgccacagcactccagcctgggctagagtgagaccctgtctctaaataaataaataaatctaaaaaatttaaagggggcatgtgtctgtatgtatgtatactttacacagtaacagaatatctcttaaaaaacataagaaattagtagctgaagtttcctccaggaagggaagcaggaagc

SEQ ID NO: 2407 - DNA, 453 bp, Homo sapiens
gctgaaaacagaaattttgctcacgagttagttcaaatacatttatgtagctcccttatatactatcaaaggagctccaaccatctggtatgtctggaagacacttcagtgagtagaaattagaagccagcatttgaaattttctaccacagggacatgaaagcctaaaccggccttaaagggataagaggattttacatttttaaaaaataaatcaattaacattcattgtcaaataacctacaagaaagttccactagcattctgcaattgtatagaataagagaatatttgttgctaatgattacattccagaaagcaatatgtttagcagctgtttttcaaaagacttgtcaagttttactattgttatttaatccaggcataaatgtgtaaccttaaacaaaaactgtgcattattcaaccagctagtgacaaattatcttaacaaag

SEQ ID NO: 2408 - DNA, 430 bp, Homo sapiens
aaaacaaacaaaacttttatggtccaaaacagtttttctcaagaatctgctctatgcaaacaataacaactttttacaaagcattttcacagaaaaggagacaagtccttccccagcgtgggaattgttcctctcgcacctcgttttcgggggaagagggggcgctattcactagtgcgggatggaaggcgcactgggtccctcagttgttcggcagctccaaaagccccagcttcccttcatacctcaacttgccatctccctaagacctaagctcccctgacctcacctgggtggaggagaaagcacttccaatcctctctgactcaagatcctcctagctggagggcatggcagagggcatgatccaggcctatctcacccctcccctggaaaacagaacctctgaccccaaacctaatcccctgga

SEQ ID NO: 2409 - DNA, 488 bp, Homo sapiens
gcacatcttaatgtatttttattttctaggtggagacgtttggtaactgagaatcttttcaaggaggagaatccaaaaagccttctgctgctatctaaggctgcttagctccacagatccgtgaacagcacgcccagagtacagagaacgcggcaaaaccaacgcgaagaatccactccaggcagtctgagaaacccgggaggtggcgccacggctggagggcaggaggatggcggcgttccaaaaggcacccgctgtcacagacctcggtgtcctgctgtctgtcccagggatggagaggactgctccagggaagctgccggagcctgagtctgtcgggttcctctgcctgccccacctcttctacgggtgcctcttgctgcttctgtgtccccggccaactgaactcagtgggcttcgctgtacttggttccaaggtgctctggactccaggagagagtccgttttgccagtagactccgggcagc

SEQ ID NO: 2410 - DNA, 437 bp, Homo sapiens
gaaatatataatcaggcaatctcccaagccagaatgcgtcagagagactcccaagtcctacattttcaagttaaaattcaggcagtgaaactccagagcacacaactgggccatggctgtaaaccagctatgttctgaatctcagatccatgaaaacacagaggcagcctcaccactccgcaggctgtgaacaggacggacggctggctactggccatctccctgcctgcctgttgatccactttcaacaggcctgagtctttctctgactcacccatcaggtggaccccctgcagcaggagtgttcccggccacagaaagccgattccctcatctcatcactcaatacctatctactgagtcctcctcctcagagtccagccctgcgctgggggcacagagaggagtcagctccccgctgagacagaaaccaggta

SEQ ID NO: 2411 - DNA, 540 bp, Homo sapiens
tgcagtttaatgtttaatgcccaattatctcaatacaaggaggcttacatggtgctcataaagacacgaccaggcgaaaccaggccggcaggaaatgacccgcatgagtcccagcacggggaccatgttctctcggttccagctcaccctcgaaaagtgccacaggcaaggttcttcagctcacccaggagccagcaggctggccaggcgtgtggccaccatggtcactgaggatcctcgtgggagaatagggttctgggacctcaggatacaatcacaagaaccagaaagctgcttccaaacaaccccagaaggttttcacttcacatgcgctaagccacacaacacctggatgctggggcacccaaaccctttccctaaaactctgaacactgcagaatggaggttgagaacacttggggagggagaacaaagtcagaaccatcctaaagccagtttttcaagcttgaccacctccctcttcctccctgaaggcacaccagccgatcccattactgtggaaaagggacaccctctggt

SEQ ID NO: 2412 - DNA, 710 bp, Homo sapiens
cactctaaagatactttttatttaaatattttatgatgatacatatacaaatataatcttccaaaaaacaaatgtaaaactaatacaaatcactttttcaggaacaaagaaaatcatttagaaaatgtgattatgctaaaagaggcaggttaggtttccaaggctgctcaaggtggaagcttaagaccaacttttgtttgagtacacaagtgatatttacattttcatatactagtgatatacctgttgcatacttggcaaaataaaactgatagtaagtctataataataaaagaaacaacaattactaagtaaacaattctagatgatggaagagtaacctccatttaagctacagacttagatgtctaaaaatatgtgtcctgatctgtacagttagtgggagcacactatataaatcctttgcatgacaccattcaacaatattttttaaaatctacaaaattttaaagtttcacatccctagcaaaatatcttcagtcaagaaattagtctttgaaaattatgaaaattgttgtgggaaatatttatacaaattattactgataatgcacatatattttgaaacattgtttctagaagcaataaaatataacctatttaggagataacccaaatgatttgtaaaaaaattaacttgtagaaaagggaaggatgttgtgtaaaatcaagtcaattatttgaggttt

SEQ ID NO: 2413 - DNA, 570 bp, Homo sapiens
ataataattttgaaatgtttatttcaaagagcgttggtaatttaaacgtcctatttaatccccaaaacagtcctgagggggagataaggcagttatcttcatagtacaggaaaggaaaaaagcgagggtccaaggccgactataccctcagctccattagcccccgaggcctccctgacaggcggggcggacaatcccagtgcagatgctctgtatcgatcgcatgctatcggttctttcaaggaacgtgtattgatcatcaattaagtggtgagtactcctctagatgtcgattcttagcaaactgcggaaactcctacagacaaaaactcaggtgtgggcgcagaagggccggggatgcgctcggtcaagacttgaaggtccggggcttgggccctgtgtcctcaccgagccccggggaggctccggctccgtccacacccggagcgcgactcagccgcggccggggctcttctggagaacggcgcggtcaggctctgccgcagctttcaggtcccctcggcccgtccgggtgcagcgcaaccaggctgcccgcggagccccaccgcc

SEQ ID NO: 2414 - DNA, 754 bp, Homo sapiens
taatcaacagaaaacaagtttaatgcaacaggtgacaacggtctggagcgagtccatgctccggaaggctcagtctgtggcagtcccgtggctcaagacaggctgaggccggctgcaatggaggccagcagcaggaggatggccagccacagcccaccacagctctcacccatgctcccagcatattctttgaacactgatgagttgataggtggcccctctaaattgcagtagcgaattttacaacacttgaggtaaaagaagggcatgggctcttccaggagaaaccgcttctcctctggcttgggtctctccatcgctgcacaaccagcggagcactgcttcgcaaccatgaaaaaacgtggaaatattttcacggccgctataacgcagtatggctctgtccatttgcacctccttgggttctggcactcgaaagtgttttctctctcacaaacatgacaccacactctattgtcaccctcgtccgttcgctgggagtcctctggatctcgttgtctcgcagtcaggttggcgtctgtccacacccgcggtagggccacgaccagcagcaaggcgagcagcgccatcgtccccagcggtgcccagggagggtcagcgcgcggcgccccctccccgcccttctggaaccttcgcagcctccgcgcgcctctccctgggtctggccggtagggggagccccgcccgccccggggcgcgcgcctcccacccgccggggcctgtcggggtcttt

SEQ ID NO: 2415 - DNA, 395 bp, Homo sapiens
aaacagagctctcttcacatttattaattcctgggaggaatgagggaggcttctccagccccccagagaccccggccttgtgctgcaacaggaggggagggagccagtccagaatccccggcacttctgaggacaccaacagcaccctgggcccgcggctgcatcagctttctgccaccaggagctccacagggtcgctgagctccgattcgaaggtgtggggcacccaggagcggtagcggcacctgtagttgccggcgtgctggggccccacgaagatcagctcgaggttcgccgcggccccgggggtgcggaccgtcttcacggccttcgtctcgccctcgcgcagcagctcgaaggtgacgtcggggatgggtccctcgcagcgcaggacg

SEQ ID NO: 2416 - DNA, 777 bp, Homo sapiens
ctcctctctttttggagggaaaaaaaaaatatcactacacaaaccaggcactctccctttctgtctttctagtttcctttccttgtctctctctgcctgcctctctactgttcccccttttctaacacactacctagaaaagccattcagtactggctctagtccccgtgagatgtaaagaaacagtacagccccttccactgcccattttaccagctcacattcccgaccccatcagcttggaagggtgctagaggcccatcaaggaagtgggtctggtgggaaacggggaggggaaagaagggcttctgccattatagggttgtgccttgctagtcaggggccaaaatgtcccctggctctgctccctagggtgattctaacagcccagggtcctgccaaagaagcctttgatttacaggcttaatgccagcaccagtcctctggggcacatggtttgagctctggacttcccacatggccagctttcttgtctatacagatcctctctttctttccctacgtctgcctggggtctactccataagggtttacaaatggcccacaacactgagttagtggacaccggctaaatgaggaagagcagcaggcattgtcatggtgaatgccccgctgtagctccctgagagaaagactgtaactctgcaggacagaaacaaggttttaaagcattgccaaaaaaaaagaaaacagaaagaaaaaatgtatcatctaaaggactagacacagaacaattggaagtcaacttcaaacact

SEQ ID NO: 2417 - DNA, 511 bp, Homo sapiens
gcaaccacccatcaataaactttcttttttattattaagtgggggcagggtttctgttcttgcaactgagtcctaacagaaaacaatggtttcgctgaccacacggagagctgaggacaggacaaaaaggcatgagacagctggacacctggagagaggtgacacaggacagagtcctcacccggctgccctgggcctcggggagctcaggctgcagtccctgggcctggtggcacccacagcacggcagtctctggctgggcttcggggagcccacatgtctgatcggcagggcttggctggccaggcggtgggcaccagcgtggtgggtgggcagtcctgggcttccaggaggcctcctgggactcaggctcttcagtggggtgtgcctgtcagggtgcaggtgggttctgtggctacactcccatcctgtcttccctctgtgttcccaaacctgctctggtccctagatgtctggagacctggggtcgtccagctcaggaggccatct

SEQ ID NO: 2418 - DNA, 534 bp, Homo sapiens
aatttttacatttaattttataccttaaatttctttatcattgaggtgccaatgttttaatggaaaagtagaaaacagtataaaattcagtatcacctatttgtctcaaatacaagtacagtgagtattaaacaggaatgacaatagagtagcaaaaacagaactgtagatttgcccaaattaactgtttctccgaatttgaggtgtatggcaagttgaatctttgatctctcagcagttgttaattacattatcagcttaacgctttcaaacactacgggaggcatttctctgttcacatagacttaagtacacatatactaagctgtaaatagtctgccttccattagtttggtctctaagcactataaatatgtcgacttcatatcagtctatgagacccagtgacccccttttcagaggcatcggtaatacatttggcaaatgtcttgaaacatgaattgtaaattaacataggtagaaccttgataataagagtcccaaatatgtatttttaaaaatgttaacattagg

SEQ ID NO: 2419 - DNA, 613 bp, Homo sapiens
taaaacacaattactttattgatttcttacaataaaatactgccaactagcattacgtccactcttgcatcattaaaaacaaagggtatttcctccttggtattttcaaatgatgcattatacaataaacgaagttagaacttaaaatgcaccctgattaattatgtaaactggtaatttgttttaaaaagcataataatttggttcctttcttcataaaatggaaatttaaatatttcttctgatagtcttgaggttatcatgagtagtgcaaagtgtggcacatatagtttcatctagaagggtgtgtatcttacacaccttaaacaaacagaatgtgcattaacaaaatgcatacagtcaatgcatgatagaaagcatgtttcaaatataaggcagcccctccggcgaccatattatttaggttttgcattatcatttatggcattatagattaattacacataacttttatacattttaaccctgaagataagaaaaataactgttgcttgaaagaaattcttccaggtagccatttggtttgtatcaggagaaaccgaacctccatgagtttagcgtctgccaagtcggaatcattagctgaagtgag

SEQ ID NO: 2420 - DNA, 907 bp, Homo sapiens
ttatttttataacattttatataactcataaaacagtgtttgtataaaaattcacacaaagttgctagagagcatacaatttccaaaaatgtcctgggtttttgttacattcagtttcctaaggatgcactccaatctatggtaaaatgcagacatgatgcgagatttcattatctttggtaaaactattctcattattttgtctcctcacagtattaagtctgatatccactttgtgcagggtctgctattactaggatgtcagaaaaacattaaggctggatctacgagaggcaagtatttcccaacagcagtaatagccccttggccctcacccccacttcatgtatctatacagtcgatctacacagccaggcggggtgcaagctcacgacctccactcgggagtctcgagatcccctcttgactgggaaagaagcaaacatttgtggggaacgttggaaacggaggccatctctaaatgaacccagtggtcatgctgtggtgtggtcagaccagcaacttttaccaattaaatagccaatctattcaccactaagtagatcccattggttggttggttgatgattgctgctgatgtggttccccactccccacaaacataaaaggaaaggaaggtttggagccaacaccgaaaggggaggggcacgtagcgcaaatgacaccagacacgactttattccctgtcaaacatttgttgtcctgtagacacagccaaggtgaactgaagggggatgcgaacactcagtacattcgtgactatcttcatacattctttaaaaacttacagagaaatcaatgaagactaccacctactgtgacttactagttcattcaacatcaaaacgtgtctgtgctaatcttttagtccttgggatacaaggcc

SEQ ID NO: 2421 - DNA, 481 bp, Homo sapiens
ctgctaatatccaaagtttatcatagctatgacaatatcagtcccaaccaggttacaagtttgttacaaattacaaactacttaaaaacagttttgaaaaaaaatatatcccaaatattaacactaaacactaccctggagttagaaaaactgtaaatgggatgaggaaactgaggtaccagtggtgacataaggcctttttgtctgacagactgttttctgaagtcagtgtaggatgtagtctaacagacctccagaagaataattcttccaactaccaaatcagcacactgagacattaaaatactcaaatcagaataaggaccgaccctaagtttaaatgtgtatttggattaacatttttcagcaggagtgtatgaagaggggagaggatacaagtcaaagactgggtagtcaggccccctgtcccttgcagaatcccttacactcaccaaacagaatattaaagcaagagctaccc

SEQ ID NO: 2422 - DNA, 458 bp, Homo sapiens
aatattgaaaaaatacaattaaatttttattaaaaatacatactccttacgcgatctttgtgtacattttgtgtgaaaaggaaaaaaaaataggaaaggcattaagactacctaattatttatactgtatttggtagaagcgtgtttcagtcaaactttaacgaaaaataagttattctgttttcatttgctcccggacgtcagaaggcagagtttcaaacagagcatcttctacaactaaaccagctcgcttcagagcccgacagtcacccagttcaggagggaggatttcaaagtgattaccttttacatctaagtaggaaagaaatagcaaatttccaattttcggtgaaagtacagataggctgttttttccaatcttcagagttttaagtttcttgcagaagtagagttcatctggaaggctttccactttgttacatgtgatggaaaaatac

SEQ ID NO: 2423 - DNA, 532 bp, Homo sapiens
ccttgaccaatgccagaaaacctttatttccaccgagacctctcatccaattctcttctttccgggaactttttcccttccctactccaggtcgtaccctggccactcctttccttttggctggccaatgtctcctctgtaggctccagaaggctctcagggatgcaggcggcctcctgcagggttgagttgcaatgggaacaaagacagctgtggtcccatagcaccctcatctggtgacatcctgctactgacagtcaaaagaagccttcccagatgaaattttagtcctctgcgcagccatgctcttcttccagcaaaagagccatgtgcagtcgggtctgctccccatgggggctttgatgtgggcccagcagtggatcagccttccagacacgctcaactctgcacactcttcctgccgcctcaggctttccaggaccctcccgagccttatcagagtccttaccctcagggctactgataccttgctgggtgaccttggacagattcacttacctggactcagttt

SEQ ID NO: 2424 - DNA, 461 bp, Homo sapiens
accagcgttccagacatttgcgataagtttaagcagataaccaaagggagtttcgtgatggagtgtcacacgtttatgcagaaaatattttcagaacctggaagcttatccatggccaccgtcgccaagctccgcgagagctgcagggcccggctgctggcacaggggtgagcgtgcctgtcccctgcgttgctcgtctctacactgacgatgcccctttccagagttgacactggaccaactttcactgctttcctttttagtgttgtaaatacttgacatcgctacactttagttgtgaattttttaaaagagcagtttaaaatcaggtcattctaccagcttttgatgattagctatgaagtcatactttttaaagaaaacttatttttacctgagagatcaataatatataaaatgttgagtgtgggtttgtatctaataaagtatgccaacacctg

SEQ ID NO: 2425 - DNA, 602 bp, Homo sapiens
ctggttttcttttatttagtgaaacattcctttgtaagtgaatcttcaatgaagacgtcccgagtgtgtgtgggggcggagggggccggcaggggaggaaagcgagcaaactgcgctcatccccctcccccggggcctgctcactcctcccaactggtccgggcctcctggcctccctcccgcggcctcccagccaatcattcttccaggccccggcccaagtcccaacttgctcaagagctcaacctcctcggggagaagcaggggtgggaaaattcgggtgacccagagactggggaaggcaggggctgagacccgatcgccccgcccccgagtcacggccaacccagcaccggggacgtgtaccacaactgcagcctcccaggggagcctggggtggttgcggggagggaaggaagcgtccctgtgaagctgcagggaggggtggggtcttatttgccccccgcgctgctttaggggaggaggtgcgaaggcaaacactgacaggacggggaattttgaatgctgttcttctaaaccctaggaaggctcagggcacagcaagatagtctcagttggctgcagagacccctccactgaca

SEQ ID NO: 2426 - DNA, 605 bp, Homo sapiens
gaacctttttttttcaggtataaacattcattcaatccaataaagacattttagaaaaaagtcaacctatacaatttattttatttttcctataccttggctaaacaaaatatatttggtgatactgtaaaatactaagcattttcagtaaaactggcaatcaaatacagcttaaccttcttctgcgtgacaactgaggattttaattggaaaagtattatagtctataaacaggaatacccaaaacatatttaaaccactcgagcactttgatttttccatgttctttgcatctagattgaaacacatcacaggaaatttcaaagaccaacggctgaatatttttcatttcaacatttccagtggcatcctacaagagaactagcactcacaatgagtcatctgaattttctttaaatcgtaactcatttttaatttctaaacaggttttacctccttatcttcagaatctcctccttccaatagccagtacagtagctccattatgaattgcagactttgcagaccagccttgggatgaatttcagccaacatttggaggaaccccttagttcagaagtgaacttagctgacagcatccaaat

SEQ ID NO: 2427 - DNA, 623 bp, Homo sapiens
ataactaaagcgtttatttccattcaattcactaactgattgctctgcttgggtgtctgtgttggttcacaggagggagtctgtggccagatccctagactgagggcgtccccatggccaagacctttaggcccagcaaaggtctggtggggggaaggaggtgggagagaaatcacacactttctctccagggaagggaagaggcatgcttgcccgtgtctctgagcgcaccctctggagggcagggtatcacagtgaatgatccgggtcctggcctccgatgcagcctggtttaggctcccagagggaaaactgggttttgaccatctgagggcactcaggagcctcaaaggggcctatttgcctgggaagtactagatagattggggcaggagagtgggaagtgggcaaggacttccagccctgcagcctcagagcccacttcctcctcaatctgtccctttcatcaacagtcctggagtgggaagctcctccaccttggcgcctccccctccacacccaaatctcactccagtctctgaatggcccagatggccccatggcagtgggctttggtgaggcctggtggcaggtgggaggagggaagagtgtcaatgaaaacc

SEQ ID NO: 2428 - DNA, 553 bp, Homo sapiens
cttatgataaaaactttattgtcttaaatatcaaatgttttacacaccactttttcttcagaaagttcctatttaaaaaaagaaaaataaaataaagtgttttgattatttagggctgacttacatttcagtatgtgacaaaaattcaaacccaaatgcatctagctcactcagtttcagacaggtcctatgttcagcccctaaacgaatggcacaatgccaccaattttgggattcctgagtttggttcccttaagttctcagagttttcccaactctcaaaaccaaagcatcatgggagtgacagggccactggcaagactttttgccagtcagcctagttcttcttttaagatgcagtagtctcaaagcttaaagtcagaaaatcttgcaatacaagagtaactgcaagaacatataaagaaggaaaagaaaggacggggtttctagttgctaagatttgccaaacatggctacaaaactggtaaacaaacctttcttgagtgcaaagtccattagcccaacttgccatgaagagatttgaaataaaaat

SEQ ID NO: 2429 - DNA, 1372 bp, Homo sapiens
ctgatgtggtggtaactttttgagggataatgaaattatgttcagcctcaaaaccctgaaaattaattataatgctgctcagtcttgcttatgcatttgtttgctctaacatgctctttccattaaaaattgttaacttcctccattgctgttaaaaaaattaaaaagggatggaaaaaagagagagacaaaaaagatgaaaaaaaaaaaaaaagaaaggaaaaggcaaaagcacttccctgggggaaaaactgtcagatagaccgatagtgttattgttgcatggttattttaataaaagtattcttatatgttatattattaacaataatttaattaaaaacccaaaatactctattgtttcatttctcttttaatatttctctctctcctctaagaaaatgttgcaggaagtttggatcctcttggtttccagcaaaacaagagaataaaacttccatgcaacccgatggcaatacgaaaaaggagttcatattgtttgcagtgacacaagaatctacaaaacacctatattataggtcattcttttcattatactatagttaagttacagactgctacaaaaggacatgccagcgtgaagaggttgaggaaggggtcagaatgaacagaagagtgcacttattctgaggcctgaaaatgagcactgcagttatcctttagttccagcggaatgaaatatgccgagggcggtcaccctataccttcaccaggggcttgtggaattccctgccagcacgagaatggatagcagcccagcaatattcacagtaatactgcagacaggtaacattagcacagaaaaatggagcaaatttccccccacaacgggccccctgacattcatcacacagctgatcatccaagacatatggcttaacttccacccgtttatctatctctccatgctgcagctgaacaaagcgggcactgatagcagctatgtaactctgttgattagagaacgcaactctcccagctccttttgggtattttagctcagggtcggtatcaatcccagcgtaacacacacctccatatagccgatccattatcatcgcaagctccacagctcgtaatggtcgaggaacaccaccaacaaatatagtttttcgtgggtcaagtggctgtgaaccatccatcacaaagtcactgtcactgagattccaaggccgaatctggactggcttatccttgatagtgggacttgatacacaaaggtagagttttccatcttcttcaatgcatgcatcaatgagagcctgcacagagctttcatcttgaaacagcaggaatgcatagcctttaggaggaaaataggatttgctctcagctttatgaggccaatcca

SEQ ID NO: 2430 - DNA, 476 bp, Homo sapiens
gatataacaaaacctttattctcagaaaacaggaaaaacaaaattaaaaaacaaaaccaataatttctatctggcccctgccccagccctcccacccacccacatatcctccttttggggggaccatgatgcatgcatagggatgggagctgaaggaaactgtgttccttgggcagaaaaaagtccttgggtctaggtgttctcctccaagttgatatccctcccagccttgcccaccctccagacacaccaagaaggaggaattctggagcagtgccagaaggactgccctgaagctccttggggaataggcggctgagtcagcaccacccccatggttttcaccagttacagctcatcttcatccagcttggcaagtctggcttggcagggaggggtttttggagttggagagactggaggagagtcatggggagcctgggggatgtcaccaagggcctgtttatccagtggca

SEQ ID NO: 2431 - DNA, 943 bp, Homo sapiens
tagggaacaaatttattttgatttttctgaaaatatcaggaactatgaaaaaacaagctcgatttctggccgtaccaaaagcaaaatacaagtaaaaataacatttgaaaaccaagtttaacctcagagaatcatgttttaaaatacaaagtttaacattctttcctctatggagctaaacaagttttctaaaccataagactgcagtttttttatttttttaactgacgtaattttttaaaagaaaaaacaaaaggggaataaacagcacttcctaccctggaatctcgtcatttataaaataacatgctcaaatgtcagtgaaaataaacagttgataaacctgaaaacaagtcttttaatgagttcaggttacaaccgaacacaggattttgtaactgggaaagaacagcttgtgtaacaaccgattcttaccaaatacaaataaatataaaagacaacttaaaaacaaactgtataatcaaaatctttccgtaaaatagcagctttcacaaagtaaaaacaatttagttccacagagttgtatgctctgtaggcatatggccaattttcttccgagtccttttgtcttgcactatcaaaatagaatctttgtcttggagcaagtctgctgaagaaggcaccaaaatcctatcctccctattcccctaactgatattaataatcctcttatcaatcattgcaaggtaacttcaatgtcattaagtattaacattctaaatatgtaaagctatagaaggaaggtcctgcctattctctttgcccctctcaaatcattctagtctggtttaccaaacagaaccaccagctaggaggataaaaatacattcccatgttcactagccattaaatgaacatagccacttgtgcaggaagcctaacatttttaggatttcctaactttttaaaacttaaggataag

SEQ ID NO: 2432 - DNA, 860 bp, Homo sapiens
ttttttaatttttcagttgtttattggaaactatagattttttttaaactcactaattattttgccatacaagagcaaaattcaagtaatacaaatatttaacattttggtataaaattaacaatatggaaaaaagatgcaaaccaaccaaaaggtaaaaaaattttaacaataacactgtgtataaccatcttctattcaagtgaccatccaagctgatagtttattttccctttgttgacattttttaaaaagatagccctacactggagcaccaaaaagttttttccttcttttttaaaaggttggaacccttttatttacagatactcttctcagtactttaagtaagtgtgatgaaggaatcatctagcaacttccttcttagaaaaaaaggaagtgccttcatatttccttgaaatttaaacttgttccattctattctaagcaaaaattaaaaggacacagttcagaagagctctttcagcaaataaataattgtttcacaaaagcactgctgtaaacaagatcactttgatggccagagacacttatgttttcaaccaatggcaaccttaaacacttccaagtatagatacacagggtatatatgggcaaaaggcaatacatcattaatcaatcaactaataaaaattaattataagcttgttgcttggtcaaatatgcttttgttctctatgtttttttaattggtcagaaaacttaaactgtaatgatctaaaaccctgtatctactctgaaagtaactacaacctagaatgtttgacactgtagttttgacattagttaaaaattctaaattatctaagcaatgtaaacaagcctcaaatttcaaaata

SEQ ID NO: 2433 - DNA, 487 bp, Homo sapiens
atcaatcatatcataccaaagtttattgattacatcaaacaaaaatttctgtaatggaaaaggcaagttgcagtcataaaagatggcattcacattcattttagaaagcaacaacgtagatgtaaaaaactgcttaagtgaaaaatgtaatattgcagtcccattttgcaagctgaaaaatgattttgtcaacacgcataaaatctgcacatttatatactgcatgttattaaaaaattccatcactaaattattacgaattttgcaaagttaggcttacatttatactgttgctggtgtatgtgtaagtagatatggaatgaatgttttcagtttagtaggtaacatcctcaaacaatggacagcggttgtgaaaattacaaagacattttgatagctcaaaattattcaaattataggtagatgatcttattatatttttttccctttctctgtcacaaatagggtgattacattgagtgctagg

SEQ ID NO: 2434 - DNA, 481 bp, Homo sapiens
attatagtaaatttattttgtataaatacatattaacattatttacaatgctaatttttttatttataaagtatctttatatggacaaaaagatacaaactgttatcattttaagtacaaagtatttctagaaatacattataagccattaaaaaaaaaaacgatatttcaagattggttcttacatgctatgaccaactcatatgaaagagcaagttgctcccccttcattccttcccccaactccaaagggaaaggaatttgatatttaggctttaaaaaatttcctactacctttatcttttaaaaaaccctactcaaaacaactatctcttataagggaaaatatcatagataagattttcctttagaaaatgacattaaaagtggcatgagccctagaatgatatgtgtattagaggcacttaaaaaaaatcagaagggatccataggaaggaatttaattcagcaaatactgagt

SEQ ID NO: 2435 - DNA, 1176 bp, Homo sapiens
aattgtaaaaaactttatgaactgagaggtcctaactccaaaaagaacattaaagacgaagtgtaagagcattacaaatgatcgccaatacacacaaaggcagagttgcagtgaaaatcaacagccagctgaactgtgggtgaaattccctttatataaacatggccttataatcagatgacctcagatgggtctctggtgtgtacaaagaaagcaaaaccaattttcccatgagtgcctctggacactcatgtaagagttacagatgttgactacatttaaacatttatcatgcttccaaaaacatatttgtaagagaaaaaaatataaaaataaaaatgtacaaagttctttattaaaataatagcttaaataaatcctctgtcaacaccagacagagtcagtgactggatctagactctagagcttagagctttttacatagttacatgaaaacatttgaatccgtcttcacagacagtgccacgatgacaatctggttaaaaccaataagccatcttccagatgcagcttaagagttcaggcgagaaaaggaactgaggaaaatgactgtacataatatggttctcattctatttgccttttttcgtcttggctgtcttctcctttctttttttcacatgtttaggaattttgttttttcttttctctctctgggcttccttgaccatctttttttctttcttttttatcaatgtcagggtccgtggtgtgtttcttggggcgggcatggtctccctgctcttcagagtctgtgtcagagcactcagagcttccaatatcttctgaatcagaacaagtcctttcctccacttgattttctaggagtgcagggaccttctgaactcctgacaaatctttcttcaatcctgtaacagtctggtatagaatattatcttgttgggcattcatggccatgtcctcttccttcaatttcataattatgtccatatccctctcataatttttcacttcattcaaggttctaggaatatatgctcgcttaaacacctcttcatccacatgatcttggctagaccgttcttccttggtcctttgagatgctatttccatggcctttgagagataagcatccatgttctcatgtgtaatggatggatctgtgacaaattcaaagatctcccgcacagtcat

SEQ ID NO: 2436 - DNA, 588 bp, Homo sapiens
catctcacttcattcaccattatttgttaattttattttgatttttaaaaggcattattcagtgtacaattaacaaagaaatcagttttctactctactgtacttaggatgcttcaaaaacatcaggtgaaatgatctatgctttaagagccagaaaactcaggcctcagcaactaaaacagagaattccaaaattgtaattacaaatcagatggtaagcctaatttcatgcccctaatattcagatttgtggacactgcaagaggaaatatcatttgcttccaaatatctggcttgaatattgctgcagttaaaggatctcgctaaggttaaacaacaaacccaaaccacttagagcttcacagtttagctgctttagcaagtgaagaggtagtcggtattcaggatgctgtgggaatgcaaatgatttgattttgaggcatggctgttcctttttcactatgcccctcactctgaacaagctcatgctttcactcaatcaaaacctacttatcacagccattctccaggttccgaacctccgtatggcagatcaaagtccataatcatttctatttataaatgcca

SEQ ID NO: 2437 - DNA, 542 bp, Homo sapiens
aaaatcatttattattatcaggagtgccttttaggtggaccgctctgtatgactctcatgcttcaaaactattttttattcaagtgacttacaatggccctaggaaacaagttctgttattatcccccattttaaaatgatgaaaatggacaaagcaaaagcaagcaacttaaccaataccccatggcctcacagcctttagaatagtcatattatataaatatggcaataacaatgcactgaaaatgtctccaaaacaaactctacattttaaaaaatgtataacaggaatctaaggaaggggtcttacttctctgattcagggagtgcgaaatcccttaaactcatatcagacctgtgatgaacaaactcacactaagttttaaaaactgcttaatttactttatcatgactagtaatatataagaattttgtatatactttattaaaaataactttggaaaactatttttgcctgatcagcaataaaactactgataagataagctggttatcaaataattccctagtgttaatctggc

SEQ ID NO: 2438 - DNA, 1056 bp, Homo sapiens
attctaagtataatttttattaataaaaagattaaccatggccatgtaaaatgagtggctgggcttagagtttgctacaccaatgaaattaaaaaattaatacttgagaatgttaacaataatttataatagcattccttgatagaggcattttaattttagcaattatttctcttaaatatataaactaatccttagtgtcatggaggagaatcatcatagctactgatcaatcaaaaaagaatttctgagagctgtttggtggtgttatctcaagacatacaaccaagctgtaggaaaatctcccaaaaaagatctggaaaactgtccagtcacaacacaggaagaatatcactgtttgacacttgtggcaggggaatatcccacttgcaagtcaagcgtgaagaataaacacaaattaagaatgtacccaagatccccaaataaattagtaaaagtgccattaagaattatcagacatagaatgtgtttcaaatacacatttgttaaatccaaaagatacagtaattttattacataaaatttctcctgtgtgctaaaaatgctaacttacaagacataatatttgtagtagagggaatcacggtcggctcgttgaattctttttcattattgaagaatagaacaataggtagtggacatagaagcactcagagtcctctgaaattcaaggttgttacattatgttccaccaaaataagactaccattctctaataatataaatgcctgttcatttcacctttcaaaaataaagtccatttcttctccattaaagtttctgcaagactgacaaaggtacattctacctattaaaaataggagcactcttcatctttggataatgtatcaccgcttagggaaaatgtattcatatacagatttttatttgaggcagctgttggagttcattaagcactttttgaacgctgtacctttaaaaatttgtctttcatatagctttggaaaaccaaaaatagaagaaaaatatctatggtaaagtatatttcattctgatttgatagcagtaaaatac

SEQ ID NO: 2439 - DNA, 787 bp, Homo sapiens
agccacaaaacattttatttacaaaatatatactgaatactatacatctggccccatcaccatggaaacaactccaaagcctgcctggggatttgtgcccaagcccagcccaggagggctagagaaagcaaaggtgtctaccagccgccgccatcccagaaggaaagcctcttcccatgagtgcctgtgggtgggcggtgagctcaacacccacaaagggcagaaggcctgggggcagtgaggtgatggtgagggcatgggaagcagatgctgctgagggtgggtggagggagaaatggagacccagcacccagcagggggagccaggtgacagcaggggaagcagatggcagggccccaggcagtccaggaccccaggctctgaagggtggggcaagggggtcaggtcacgtcttgacatccagcagtggcatccgcttgtgctggtagccactctgccagccatgtaccaccttggggtctcccatgtcagagagcagctcctgctcagcctcatgcagttcctcagctgggtcatagctgtacatggggagcaggtgcatggcgcagccggtccacccgctttttcttctgtacatacattaccacagccaccaccaccccgaccagggtgatgaggaagaagggccccaacacatagcccaccatggagtcgctgttggcctggggggcattgggcacagtggtgttactcatgacatcagcagccggagggctgggtggtcagcatgggcagtggcgcttcgggagggcgcctccactgggc

SEQ ID NO: 2440 - DNA, 1052 bp, Homo sapiens
gccgggacttgaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattgctacaagcaagaaggctgccacacagcctcacgctcaggtcactgtgcggccctgctccaaactcctggaccccatccaggtcatcagctattgctctttggaggttgcaacttagctgaaccagaagtagctgggcattggagtcatgggaaaattaaggaggaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactc

SEQ ID NO: 2441 - DNA, 505 bp, Homo sapiens
gtgagcatgaattatttcttgttttattgctttcttgtttctttcttgatgcagagtcaatgtttttgagtaacagtaataagatgcccaaaatccaacagtaaacattcaaatagtaagatctgatgcagaacaaagtcctcaaatgttaactcctataagttacatctagcggaaccacgagggataaaggctgaactcatcatcttggtttatgatggaaaccgctatcctctgacccagggaacaggaggaagtctcgaatgccagccacctgtttaggcactggtggcagcactgtggtctcctcgtgaaatggccggggagactcacagtgagtctaagtatggcaatctctccttttaccccaggattaagagatgccccccgcaactgagagaatcaaaagaaactcctatggaatagaagacgtggttacagtgataaagatcagaaatgattgtgttgtcaaggaagtgacctgtgactgcacagaaccccatct

SEQ ID NO: 2442 - DNA, 540 bp, Homo sapiens
aattttcatatttcattttttattagttttgttttttttttctggtagacagtacacttgggaattatactgcaccaggcataaagagtaagttttctaccacagggacattttgtattcagaattcaatataaatatttctagtcagacatttccatggctacagatatttggttccttgatttatatgcatagaaagaaacagttgtcataactgtaaaaagcagtacttaataagtacttttaaatgattggaacagttttcctttaatattacaatactacttatttattggtttggaaactaggtcaccctacatgatgttttgatttttctcaaaggcatcatgagtactctgcttattctttcattcttgtatttttagccttctagttgagttagggaccattttatcagaaatcattttagcactgtaataagaaaagctctgttaagggtagattatataccataatgattttcagacttctttttataaaaaaggtatctggagactctgaacaggcacatgcatactc

SEQ ID NO: 2443 - DNA, 656 bp, Homo sapiens
gaagagataaaacttagctttactaagttaaatcagaagagaaaaagacagatctagaagatactatttccaaaacatgtattctataaactgaaacggaaatgcaagtggccagctttcttttattctttcaccggccaagggggagcaacgttttgtgcagggccacttcaccaccaaggactctgaccgcttctccacctccaggacaagcactgaggccaattccacctccaatctgctggtcttccacattcacacagggccatttcaccaccgactcctactgcttctctgcctccaagaggagcactgaggccaatttcgcctcgattctgaatgtctcccactttggtgtagagccatttcaccacagaggactctgaccacttctccacctccaggatgagcactgaggccgatatcacctccattctggtggcctcacacagcaactcgctgctgaacccagacatctttgctgaagtcagttgactggacagtacagtgcaggatctgcgtgtggcacagggaaacgcaagccagctccagtaccagcaggtgtgcgcgaggtacaagatgctctgcgtggtgcccccaacccactcctgtacacctggcaggtggacaaaacgctcgacctgggcagcatctcc

SEQ ID NO: 2444 - DNA, 878 bp, Homo sapiens
gggctctgggtcccggcgcccctccggccgcgagtcccacgcgccacccccgggcgccctcgacggtggatctagcggcggcgaggaggcgggtcccggccccggcgaaccccagtcccggcccccggccccgggcccagcttcggcatggatgtgaggttctaccccgcggcggccggggaccctgccagcctggacttcgcgcagtgcctggggtactacggctacagcaagtttggaaataataataactatatgaatatggctgaggcgaacaatgcgttcttcgctgccagtgagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgactgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagccattggagagaaaagagctgctccagactctggcaagaagcccaagactcc

SEQ ID NO: 2445 - DNA, 522 bp, Homo sapiens
aatttcatagcaacatgtttatttaagccctagctaagttttcatttacaagcaaatattttcaggggaaaaaatcacataagacaatattttcaaatgttataccatctacataaaaattaaacttgcagaatttacaaattaatattctgagcagacagaaatattatacatccttttgcaaaatccagtcaacaacttttaaaaattcatacaggcacaacacaagatagtctctctatacaatctacctatttacatagcttttcccaccacagatgataatagctctcatcatagctaccaaggttcgcaaacatagtatatttaaaatatatttagcagcatataaaaaattagataaaagggaaggaaatactactattaaataaaaacaaaattaaatggtcataatagaaacaactccataggaaaatagatcaaaatatatttctgttaggacatcaacaatgtttcccatcacagaatatatgcacagcactggaaaaaaaaaaaaaaatt

SEQ ID NO: 2446 - DNA, 518 bp, Homo sapiens
agtaacagaaaaaaatatatatatttcaaaggtaactagttttgttttactcaaactatttacaacaaggggcagagtagagacatgaatagctgcacaagttattttaattataaattaataaaagcctacattaaattcatcttattaactacttatgagagtgtataaaaactgatgaagccaacattatttggtacttctgatacttccattcgcttcaacttttctttctaaatagaaaattaaaagatggcaagccatttacaaaaagacatgtaattttgttaatcaggttgacattttgaacatcttcctcttcagttcagctgtcttctcatctatcttagcataggagtcctctgctgccttttcaataccgtcgtggtatttctccaaagcagttttcaagtttagaaatatttcctgggacttcagtttctccctttcagcagcatcttttagttgttgaattccaagtttaattttttggatttcttgattaattgtggttactc

SEQ ID NO: 2447 - DNA, 421 bp, Homo sapiens
ggcggaaggcagtcatagcaccatttattgtccaaagtacacacacctgagggcccctccccacacagggaaacaggagaaacaaatgacaacaaaacagattctttggaaccgagaggggaaggggaacggggaggggagtttcttccttccctcagctttcgcctggaagcctagaactggcttccagccctagcccctcagtgggcagactggggtcagcggcttcacagagaagtagaggtgggcaggagaggcccaaagcccagctccggaggcccccgaggccctcttcttcccccaggctgaggggcagggagaactgtgcccaccatgcccggactcccggcggcattctagacaggccaccgcccactctgggcaccaacctccttaagggagggagaccagcctggatggc

SEQ ID NO: 2448 - DNA, 471 bp, Homo sapiens
atatgattattccagaatattttattttcccaaagaaggttaaggatagaattttgtagagtttttgtttttttaatgcatccaacacataggagaattttattttaaagccctttttaaaaatgaaaattctagttggtcatcaattctcttcagagcaaacatcatttattctactctataaaaagaaacctaaacaaattaagatgacaagtaagaaaaacttattctctttatctcctttaaaaccaaaattttagttctgctgggctggttttcttcaaattctcattattttaccaatgaggcactttataatacaaatgcttaaagtgttgagggattctgactcccaaaaacatcatttgatataacaagatttgtactactgatgttgatatacacaattaaatctttcttctagtgaatgatgaaaataaatgttgaagtaaatactgatcaaataaatgc

SEQ ID NO: 2449 - DNA, 863 bp, Homo sapiens
gatagtttagcattttatcctcatttttaacctacaaagtgtaatgttctcataaagtattttaataaatatattaaggcttaaggtaattactggtttgagtggcgggtggtttgctttctagcacactagtttacattcggaatcttaaaaatgaaaacatttgccatcttacagtgagtgatacatcacattggcttgccccagtttttgtgttcttttttttttttttcactattcaacatgtcttcgtattatcttccttcctctcgtatctgatagacaaagaatgatataaaattttggttgaaaaaagccagttgattgggatgactagaaatgttaactttttcagtaaaaagctttcaccgaatcactgggcagttagtaatgcagcttacaaataaataaagctgaggcgagaggtttaaacagcaagaaaagctgcagagcatattgaggaagggaagcagtgaaatggtggttttaatacatcccaaactggaagcaagaaccctaacacaaagaggattggaatactctaccatctgtaaggaagtagctagctacaagccacctcacacaaaacacccactaaggcctttcaccgagatcctcttgttatattctcattatgaatccccagcaggtgcacctcaataaataggtgtggaggatactgctgaggacctctaggtcacctaagcagaaactgctgccatcaaagcagactgccaccatgcatccgcggagaactccctgcctacaaatgaaactggtagcgctcatcccctgtgcccgaggaccgtccacaacggaggtgctttcttgcaagagaagcagcaaatgatgacagcgtgtcc

SEQ ID NO: 2450 - DNA, 527 bp, Homo sapiens
gggtttgcacagtttattaagataatcaatcaatttcttaagttattcctttgttaaccagacagcatctctggagagaaaatgcactctctgtgtagatacataaaaatacatcagtcattttgcccctcctggatgtgaacggaatctcccctcctcacctccacagagggagctcaagccccagggaaccttcccctccccttttatgcattaccaggggagtggcaggggcagcccccaactgtggggtgcattcaggtctgaggggggaggaaggctcagaggggcatctccccagcaccctgccacagtgctggcttctggggtgtttgttcagcggcctgctgggctgccccaggctgggggctcccccagctccccgtgcatcctggcttgttccacggagccctgagccaagtctttgtctggctcatgttcctctcacaacatcccacaggcaggggtgagcctgccgcaggaaggagtaaggtgctgtcattgcggaatcgattgcgcacaggaat

SEQ ID NO: 2451 - DNA, 510 bp, Homo sapiens
acttttcaaagattttactaaatcatttttttaaacaaaatatacattaaatctcagatttacagaatatagaaataatttatccaaagaaatttgcatttaaaattgttaatattgcacccaacagtatgtctttgacacatttgcattgtcaatctttcccacaatttgcaaaaacaggagagaaatctgaaactaacagaattacacaagctaagttttctgtaaaaaaagaaaaaacttacaattttttatttacaagttaaggaaaagttgtaaacgttcaggattttacttccacagaataaaaagccatacattcttttatcatacctagaaaatgaacatatacacattgtgattacctcataggaattcaacaggactgatattgtgaacattcacagcccaatggtaaaaaacagaattctcgaactatggaaactagtgtgtgaaagacacagaatgagaaaaatgtctggaaaaaaattactttctcctctttgagga

SEQ ID NO: 2452 - DNA, 549 bp, Homo sapiens
ccctttacagttttattaataattattatttttcgtataccggttgcactgattcatttttgctcttttattttttaggcagatggctggtttttgtaggattaagcagtgaggaaaaacagcaaactaaaaatgctacttcaaatatagcaacagtcactacataaggcttaaatcaatatattgcaagtaatttctatgaattttgaacaatacaatgtagtgtatgtggaaagatcttgcctaataagtttcattctactcctcaaagttactgaagtcagtcaactattaataacagaattgtttttatagaaagattccatcttctttactgttagatgttatacgtgtcttgtactaggataaaataatgagcattgtgcatcgcaccttctgataatctcatacttctataaatactaagataaataatcactcttttaaatttagagagagttggttttaggctaacaattttttttcttctttccaagacagagtcttattctgacgcctatgctggagtgcagcagtgcaatctcagct

SEQ ID NO: 2453 - DNA, 513 bp, Homo sapiens
cccctccagtctgagatttctgtgtggctgatggagagtgtgatttgggcgtaggtcttatttgcaaacctgctcatgttctaagctttcttcaggtagtaccacctgtcatcgcttctgcatatgatttaaatggatttttgtttttataaaagtatcataaatttagagataaaatggaggggacccagctttctttacaatgtggatctacctcagttaaacagttgggtgctattactaagtctgtcaaattaaattggaaaaagtaaccaaacagtgagatacaactccacatgaaacttgaaattgtaatttccgtttatttaatgatatttttatttatttgtgccttttatgttgaaccccaatgcattgaaaaaattcagtatgaaacagtacatattttatttatattacaggtgggagaaaagtccaattggtcatggaatttgatagacttttccccagccaactgctacagtgtattataatcccgactgcccccctgtg

SEQ ID NO: 2454 - DNA, 795 bp, Homo sapiens
aaaaaaactacttttatttttttttatttctttttcagttacatacttttaaacagggatgtgtttcattattcagacattcaggcaatgttgacttcattagtgttgacagaaaataagcataaaaatgcaaaacattgttggcttaacctgaacatacctgcattacctattattgaccagtttgtgttgccaaaagacttattcctcggcattaaaatggagcacttaaaaatattgctaaaaagcaaatgcctacacactggtctttgcagcaaataagggtatttatacttttaaaatattttaagtccataattggattaatatacacaccttcttatgtataaggagttcagatcatataaacactgtacaatccaaaaaaccctactgagaataaaactaaataggcttatgataagaaatacagatattcgcatgtatttacaaatatcatagacacacaagtttggtcaaatactgtaaagaaagaagaagtggtttcacattataatggccaaaatgtttatctaccttgctcaaagcaaataaaaatataaactcagtatgtaactcctgcagtttaagacatcatgacagtatacagatagatagaaactgttgaccaaattatacagcaaatgttttgtaggttaagtgtaggtctttaaaataaaaaaaagatcattcataggattcatagcaacaatgataaacaatgtcctgatttgtggtgttcatgtgggtgcctaattcatcaaaaaaaaatgcattaaacttttggctaataag

SEQ ID NO: 2455 - DNA, 1303 bp, Homo sapiens
ctctgctggagcaggacttcagagtgtttgttttcagcctgcttttaaagtgatttgaagagagcggctttgaagattatcgcggaacacctgcccattaatcttgaccctgttaaaacaataactgcctatccagatatgccacacttctgcctgctgttggcaaccctcctggactaggctgctcttgttaatcacatggatgttatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtgatgccaccattcctaggagaggcagagaccagcctctaaagcacaagccaaaaactgtgtgaacggtgaactttggagtgaagatcaatcttgcacttggtgaagagtgcacattggacctcaaggcgaaagccagtggtttgcttggataaaatgttcccgcatgaggccacaggactgaggatgggaatttggcagggcctgagaagatggtctgacttccaggcttcctggtcaaagagagctacgtttgggcagttctgcagagaggatcctggcaactagtcccacctgactaggcctttagctgaaaggatttcttgacctccttgactgcctcagaggctgccaggtcaaaccctcttgtttatgtgattagctcagagcatctctatgaaatctaacccttcccctcatgagaaagcagttttccccaccaacagcatagtcaatgagaaaggcaactgtacgaagaaaacttccagtggaactaatatgaaatctatttgcaaattatggggggaaataaagcttttaaattatacaatgt

SEQ ID NO: 2456 - DNA, 502 bp, Homo sapiens
cagtgttcagtaactttaatacagaaaatctatttgatatttattaaacttagtttctccaactatggtttggcattgtacaaagcatcttaatgacacagtagagttaaaaagatctttacaaattgaaatgtgatacccttgtctccaaatattttaattgccataaatttgtttaaaaatacacattaaacgcatgtttgacactctaaactttctatactctcaataccacaaaatacatataatatactatacagatgtggaaaaatctagttagtatataatactttgctcaccattaacagctttatcgtgtgaaatgcacatactgacttagaaatcctagcttttgagccccaaagtacctctgaaattgtaatgtattgcaacaaataaaaatcacagtatataattgaaattctggttgaaaatgtcagatgcctaaatattttggataaaagaaatgtaaaacaaagatttggttcatgtacaaaacaaa

SEQ ID NO: 2457 - DNA, 513 bp, Homo sapiens
catttctttccttattctcctcttccaatgaaagagaaccataaaggttgatttcttcttcattttccttaaaaaatttccttgagtctgtcatacaccagctccaataacaccaaaggacacggggagagcccactggtaccatcttggtaaacatttaattagaccgtaacccttctcttggggcagaggtcatcttgcacagatgcacatggttgcctggagtctatcgtacaatcatgtgcactgctgacagtctaaatgacaccagtgtcccagttttgtgctgacagtccacagcaggcaatgtttctgcgactgcaaacctgaaggcgacgaggagtttctactttcttgatcagcatgaaggggcagagatcaccagttggtggcaacatgtggaaggccatgaacccctaaatctaaaaatgtcactaagagtcaaaagttccagagctctctcagtgatggcacacccaactccaacccatgtctttgaggaagctgagaaat

SEQ ID NO: 2458 - DNA, 687 bp, Homo sapiens
tttgatagtaagtgagcttttattttattcaccataaaatatttgcatctcttactcctcaggttcttacataagacaacatttaattaattaagttaccattatagccatcgagggcctgagaaaccacatcctttgcaactgtctcataaaccaagtcctgggaggcatcgtgaagaactccatccaacttaaacgaccagtctgtctgttggttattgacaactcctctccgaatgtctttttttaagtgaatatcaatgcttcttttgtcatctccgtatctgatcatttcatgagcaaagtcatcggtgggtttgacacggacaaatgcatgaacttttttcctagtacccattctagcgttcaccaggcagcgacgctcccgggacgcgactgccgcaaccgaaaccacctgcactccccacgcggggctgcctggctgtgtacatagtcgccatggcaacgggtcgcttccggggattccggaagtgtcggggtggcggaaatgaagtccgaggtcctacgtcgaggatacgggtgaggtcatggccgaatcgggaagacgagagatggggccgattgatctagaaagacttcggcggatgcacatgcgaagtcaaggtcgagatagcgagggaacgaaggccgcacatgaaccaggaagcggagtggcggggcttccgg

SEQ ID NO: 2459 - DNA, 490 bp, Homo sapiens
gggtttggatcattggattttattaaataaaaaagagaagcaagtacaaacaccagtcaacttcagaaggattttaaaattgcaagtgtgccatgcagctaaggtttatcaggctcctcagttagtctgcactgtccttggggaggggacacagctctgaggacaggggatatttcccagggggttctgggatgaggtcagcactaactgggacagcccctgtacaacaaaggagcaaacctaggccccagggggatcctgtctcaggagaaagagagaggcaagaagggaagaggacactatcatccacttccaaggaaagccacctcacagctcagtgtgtgcaaacagcagctccgctaatttccagtaaggaggccaaagtcaaaggcacccatggagaatgggataattcaacaggaaagactcggtcattagggaaaggagcatgctaggacaggtctgggtgcacccctgaatctagctctga

SEQ ID NO: 2460 - DNA, 491 bp, Homo sapiens
gacagaatgagaaaattatgctttttattatagtcacataaaataaagtcagttacatcaagttgtccaaatgcattggtgaattaatgccgctaacgcttacaaatttttatacatatatctatgcatttataaatacatacatatgtaaaagatatatattttctactaaaataaagtacccaaatcttgatatatataggggcataatgggggagaaaagaatcataaggttttatcagttgtagactgtactttcagaatacaagagtctgttttagacacatttattcagctgtaatgaactttaatcacccattcttttctgaattctcctaagtgagttaatgtatccaaaatatcaaaataagtcatgtggcaaacttaatgaatcagaggctaatttttcttactgtacctggctcaaagtctagacttcccaatggaggcatggttaagctccattcttaatttgcttgtcttttggactg

SEQ ID NO: 2461 - DNA, 562 bp, Homo sapiens
aatttaaagaaaacttctttattaagtaaatggacagttggtacacagatattgcaaaaatttcgaggcgggtacatgaatgactgaaattcaggagacgcggggagttagcacagaagcactttcctcattcagagctcttttggctgcgagaaacagacacccaatcaaatcagcttcagcaaaatgagagaatgtatcctgacaagggacgctcacagggcctaaaggaagagtgctgggcccctggaggactgagggaagccggcaggtccctggaggcggtgcccggctgctctccaggcgcctgtgattcctctggtccctgccttgctatgcgtatcttccctctgagcagagccattttctctaccacattcatgcaggtgcccatcccccgcaacacacacagacaaacacacacacatggacacagtcacagctccagggtttctatgtgttcaggtaagggacctgcaaagcctgaacagcctccctaaatctagatgcccacctctcatcctttcagctcccatcagaggatcaaggggcccaaattcgc

SEQ ID NO: 2462 - DNA, 736 bp, Homo sapiens
aaggttgaacgaagacatttatttgtaaaatcaattctcaatggaggagagattgtatccatagaaagtaaaccagtgatcgttcagagggccacatgcacgcattagtgaaaccaagggaaaaaccaaaaagacagcactgctgcggacgacccgcgtggctactaatcctgccaacagaaaagcaaaatgtcctttccgcttgagaacgcggatgcaccaagatgtcctgtgagaaggcaatttggtctgacatccacgatgaagtgatcagggaacaagtgggggagcgtttttttctattccgtgtggcctgcttgtttcccgcagaaactggctgaccgcttccgttgtcctcccgcctccagtgggagggaggtggtgtcaaatccctggctttctcacatgcccatccttatgctctgaatgatctgaaagatagcttaagggagctgatggctgatgagatgtcttcaggctgtgcatctcagatcccgaggatgaactccagagcagatgaatggcctcagtctttccttcagggccagccagttcctttaaacatctcagttgccggtcttgggggtggggtgactccctctggatgttacaactttgagaaagttctggcagtctccaggagaggccaatttatgtggttgacctgagccacagacaacaaagacaaacagtgccaacagccatggtcccacaggatatttctcctcttgcggcc

SEQ ID NO: 2463 - DNA, 665 bp, Homo sapiens
tgaattcagtcaagtttattaaacttgctgtgtgctcagcaccgccctaggcagtaacatgaaaaacattacaaaagaagatctcaacaagggaaaaatatattctgtactatattaatttccaatcatttacatgttgctttttaaagtgttcttaggtcactttggggtatgtggtctccttctttctccatgttcccctaaagcttccacactgttgaattatgtgcctgtggcgaccatcctccaggaagggcaccttcctgctgatgaggcaaccatgggttggtcagggctggggtcccgtggtggaggagacatgctgagagaaaaaccatcaaccccgagagctcaggacactcacagtgaatcccagaaggccaaacgtggggaagccacaaagagggctctgggcccctcactcaccccctcccctaggggatgtgcttaaagtgctaacgccgtaggaaaatgatgcatagctacaagccgtcctgggtgctactagactcatcgcctgcctcttcctccctaacttgtgctaatactgggcgatggcacaggccaatagaaaagtctagtgcccagtgaagtagtagagaaggtccaacgtgtaacctagaattcccaagaggaggtggggacagaagagaagaagtgaaggg

SEQ ID NO: 2464 - DNA, 626 bp, Homo sapiens
atccaatttgatttttaatgtaattaatagtgatttaattttcaaaggagcaaataattacaaacaagagaaaacattgctgagatggtgcctggttgcttctattcaggccattgctgaactatatagaaaaaaagtatattcatggtgtcttcattattatgaaaatcacagtaatatgactcatcaggaaatcacaataattttatgacagaaacaatatatttagaacgaatctgtcagtatttgactctcttttgagggaaaaataaatgaaaaccacgttctctggaaagaaataagacaagaaatgcccacagttgcattctgctgttgggaatacatctccaaaattcaaggttcaaaggttatcacatttaattttcaacacttatcaccttcttcttctctcaatttatggagatagatttctacgttcattattcgggattattagaaatttccttcagtttgaacaatgcgtaacaagtattctgtgacatgggtgcaaaaagttgtcattttcaatcaagttataagacataactgtgcataaagtgcatttcaaattaaagtacccatcaggagagaaatttaaagtgcaatacataaggtactttacatag

SEQ ID NO: 2465 - DNA, 964 bp, Homo sapiens
agggtatcaagattttacattactaattctgaattcgttatcctttgctttcagccatattaaaactgaaagccttccatacctgacgtttttctatctcattatacagctttcctgtcagatcttcttttagggtgactttgaagaatcagaacatcagggctccaactctcagtagagccagtaaccagcttcctgatttaaaaaaaaatcacctttggcctaattttgtcacttataaacagtggtattgcagtaccctggtatgattagttatgatatgtttaacaataattttaaaataccaaagcttgtgaattattttactttcaaaaaatatgtaagttagaattgtaattctaaaggcactgtcgtttgcttacacattctaacatatttctaataagaaagtacctgctttcttaagagaaaaagggataagttaccaaaagcagcacgttctcctgggctcataccccggattcatccatgaggccacttccattgtaaagcttttagcatctcttgatttctcttgacactgaggcacaaaggcctgctacttataggcattacttcatttttccttacgcacggccccccccccccccccccccccccacagtatgtttaaaaatcccaactgcaagatacacaggatgctgtaggcctgatttcctgttgtagaacctccagccctgtgttgaatgaggaggtgcaaatatatagacccttaagatcagaccacagcaggcattcaggtggaggggatgaactccattcattccagctgtgcagtgggacatctgcgccctccgcatctcggctcattcctcatctgagccactcaagagggcggtctggtaagtgtcatctgaattcagcttctgaattccaatgatttctccccttccgtgtctcttcatccgagtcaaaaggcagtaaacaagagaatagttgacgg

SEQ ID NO: 2466 - DNA, 630 bp, Homo sapiens
caattgcaaaacaggtttacttttttatcaaacaagattatcacataaaaaatagctacagtgctacggtagtatataaagtgctcaagtatcctgaatgtaaccatgagtcatgacaagtccctccctgaacgagagagagagggcgggacttctgcctggctgcttgaagaaaaatcttcgcttgggctgatgaacgtggcctgagcgggggctgacgaggcacccgggttgtcgtcctcagacaggggcgtgttcttgggtgctcccccagattctctgcaggcactgtcttgattgaaataccaccggctggggggcgccatgccctgggtctcttcccagacttcctggtttgccaaggctgcctctttgcttgcctctgcggagagttccagcacctgggcaaagctccttcggagctcaaggtcctttttcgccgtcacgtccttgagttcgctcagtaagtccagcacctgcacattttcttccgaatcaccaacatcaagttctcccaggaggcgctgagtggtcaccagttcatgctgcagggcgtctaagagctgctgcccatctccctccaggtggatggacctcacgggcagctcgtgcctggtagtgtccagggcc

SEQ ID NO: 2467 - DNA, 708 bp, Homo sapiens
aaaatctcttctgtcacacacagatgaactttaataaattacaaatgcacctgaaaatgccttcttgatttcctttcagtttaggcctcaaatgggctctcctcaaggctggacctcaaaggcccagtttgggccttcgcaaatgtctctaacccttgacttagagtttgaagattcattccattctggatgtgaatgcaggtaacacccagtttgctgacgtctacaatattccgcctctcatcatcaaagaagatcatctgggagaaaggaattccagtcttctgctgcaacctctcaaagtgtgtgatcttgctgcctggatagatttcccgatgaacaaagtacctgaagaggtcaaagagctccagtagctggttggccccttctatctcacttgtccttgaagcagccgcaccgggcaccccaaggctctgcaatcgttttaggacctcaggcacctctgggtacagtcggacgtcttggccccgcctatctcgtacagttccatcactgctcttatggaacggagggtctacgtgcgtgtcgacccagaaaggccagagagtgtaatccaaatcaaagactgccagcttcggtagccgcgccatgacccgcaccgcagcgtgcgcgcagcagaggtggggcttcacccggggccttagagagtgcggaacctccggcagctaagcagccaccctgcctgcc

SEQ ID NO: 2468 - DNA, 658 bp, Homo sapiens
aagatttacccattttttattttttataaaacaagctacaaatagtttccctctctccttcacaaaggaaaaccacacaacaccacctacacacacgatcctgtgggagacaagatgcctggggagatctcgaagatccaaacatctacaggcaggcgccgtctccatgtgtgcatgcttcctccaggcctgaaagtggggccagtgtctcgtgcaaggcccactcagctccggcacgttgagttctctcattggggctaatgggagaaggcttccttcccacctttccacgttggggcagggccaccagtcattcctgagataacctctaggactttctccaggacagcagggacctcctttagcccaagaccccatcagatcctgtcccgagaaggttgtgctcctcccacagggacagtgcttgtggtgccaacgccttccagacccggaacgggtggaggtacttttagggatgtcgggttggaatacaagatgaggccagatttgcaagggtgatctgaggaggggaccagtccagggctacccaacctccctcactgccaccacagctgcttatgggaaggggcgctaagggccacttgctgctctgcctgaaggccacttgaataggcacagcacctgggcagagggagct

SEQ ID NO: 2469 - DNA, 475 bp, Homo sapiens
agaccttcatcttctttattttatatatgatgcttcttttaatgcagccaaaagtgatatttgcttttctcagaaccataatcgatacaagatgcagtgaccaattcattccttaaaacacctgggctccttaaggggctagaagacacaagttacatccagcccatcagggagccagaggcgggaggggtccccagccaagctctggcaggcctgccatggggcagggcctgaccgtgcagccagaggctggcagaggcctggggaagggtgggcagaggcagctgggctctcagtcctggaaccggagaccaagggctgctcatcaagctccgtcaggcaagggcggcctcatctgtgcctggtagattctaactgcttccaaggtagaggaggacgcgtgcaggaaatcgtgtcaattgtcaccttctgcctgcctcccacagggacactctgggttgggagcctcttccag

SEQ ID NO: 2470 - DNA, 680 bp, Homo sapiens
aagtaatagtacttttaataaaattaagttcttaatagcacatttaatacattaaccctcccccttcttggtttctctgcattttgtgcaacatcactttgacttgattattcttgggtctgttttatttcccgcttttattttgcttttgaaatctttttccttggtggatttgtacgtgtcttcactagatgcctcaaattaagtctgaccacaatcctactctactttctacagtggagagaccatcctccctgccccagggctgtctccacccacccccccttccccacccgcaccctcgagtggggaaggggaagccctccccaccccagacgctaccatcccaaactagcggggtttctaggacaaaaagagcagggggaatctgtccctaggtggggcgagaagagtaaattgggtagagggagatgtgtttggggtctagggccagggagggggatggcagagtcattggtgtaatgaagcaggctcctcctgccaaaaggagagccaaggggcccctccaaccccttggataggaggggaaggcccagtgattgcaagctggggttggtagaaggcaagtgctttaaaaatgttgatttctcacacgcagaagccaagccctccagttttgtgtggggagggcaatgtgttcccaggccagggtacagtag

SEQ ID NO: 2471 - DNA, 691 bp, Homo sapiens
ccgtacatagtaatattttattttcttcccaatgtggtaactaaaatacatttaaacgaaggctagaatttaaaacaaaattcttttactgataagcacacttgcaaagtaatgaaaatgttacatgcattgctttgcatataaacgtccaagaagtatttgttgaccaaatgtctgaaaatgaagtatttttatctgttccgaaacgccataatattgcaaagaagcatttcaaattattgttgtgtgaaatgttcaaatttagcattcaaatttagcgttttcccacattttacccttcaatttacacaatttggaagaagagtagatgagttggtcattgttacttaaaacaatgcgtcaccttgttagggaaagaaattaacataatggtcaaggagtgataattaaacagaacatgacatttgctgtccattcaatgttaaagttctaagcaaattagcatggagaaaagggatgggtagaaataataacagagcactagttgattagtccgcctccacatccacgctgcaggcgttggacagatccggctttactgagtccaccatgcagggaaatggacgcgcgggctaagcggaatcccaggggcgcgatcgcaccggctggcgttccagcaaaccctgcatcccaggccctggattcaggctgccttctgagtctttgactt

SEQ ID NO: 2472 - DNA, 545 bp, Homo sapiens
taggtaaaagatttttattcttatttaaccatgctgcatgtatacatacaataccaatatatacaacttgaacaaatacaatttatacataaaatacaatgaaagcatggcttttgaaactgatgcaacaaactgtaatttgtaattttggccagcatacagtattatagtaatgctactgaagttattcattaaattagtcagactacagtataagttcaaaggcactagaaacatctatgttttcttctagtatttttaagaacaaaaaataatttaaaataaaacaaatgtatacattaggaaattgggcagacattggtgtacttaaatgtaaacgctacccattccttaattcacagccctgtaggaaagaagactttccttaagagttaaggggaaggatattaaaaacagactaaaaggaaacaaacaaaacaaaaaacaaccaaaaaccataatcatagttttaaaaacatgttacagaggaagtagcaccaccccctcccccaataaaaccttaaatttttgctgtaaaaaaaaaa

SEQ ID NO: 2473 - DNA, 539 bp, Homo sapiens
ggctgtaaaatcatatatttactatgtttgaaagaaataatacaaaaaagagaggaaaataaaagcaaaccctaaaaggtcactaaagaagtcataccaacctcatcacttgctttgtatcatctattcatgcaacagcagtactattactccacctggacacagttaaactcatcttccttttcaaaaagggatccaattatttcaaaaacctttgaagcagaggatttgctttattaaagattatcttctgttaggcaacactggcaccccttgtttgcagaagatgattacgtggtggtttaaacactggttgtaaaggaatgtgcctcaaaaaaacaggaaggaaatcaataccagatctattcatttaaaaagctaatggatggaacccattactattgattttcaattagtatgatgccctatagttttgttttcagtagtaaaggtatacagtttacgatttaaccttaaaaagaaataaaagacttatgctcaagtcatttggccaaaagatcaacaggctgctctttgag

SEQ ID NO: 2474 - DNA, 721 bp, Homo sapiens
gcaaagcaaaactatattttattaataaagtcaatggtaacatttgcttacgtattagaaatagccctgtgaaattttagctgcaaaagggaatcgtttaaaaagcactgctcaactccaagtttgacttacagacaaggtaacagccaccaaacaaatgaaatccctcttctcctttacagctgctccttggacagagggaggcccgtcatctgggtctgaaggaggctcccaagactctgacacagaacactaaactccagggtgttctaggacagtgacaggcaaggctgttctcaatcatctcctgtctgacacggacatcgagctaagctatgagcaagggcgaacaatgcctctcagcagctcctcctccttgaccaggctcccgaccacggagcatttcagtcaaggtctagggatttgagggtggaaggagagaatttcatcactggggaggaactcccctcacagaccccccagggccactcagcttcaatcagctgtaacccagccccaacatctgcaggccactgcgcagggagtccacggtcagcagccacctcagcacacctcctcctgtggccacatcttcactggtttctggaatccaacctggggccttcctgaagccaagtgagaaactcaggacaaggcttctcttctttgaaagccacatcaagtagcacaaaggactgaggtttgcagctattttatttac

SEQ ID NO: 2475 - DNA, 456 bp, Homo sapiens
gggatttcattatctcagtttactttaatttgcttgtttacacacacgatctgtgtgtacataacagtggcaagagccattctctaaatacaatctggtacccagactatgacagatgcacgtggaaaatgaggcgtcagtgaattaatctcaacatagaaaggcaaaataagcatggcagtattctatgatcacagatgcccccagagcctgggggtaaccgacacttttcaacataatacaggacaattttaacaaaagacccagactccaaatggcacccaaaatatattcgtttctctgccttctctagaggagtcagaaagttctaaaggcttactcaagaaaaaggaggcagggagactatggcctgctaagcacagatgctgagcactttacatgcaccatttctcttcatctccacctgacagacgatgaaaacgaggtttgccatga

SEQ ID NO: 2476 - DNA, 437 bp, Homo sapiens
atagtgggtccattttccaataattctcaaaggagtctgagattccccaagctttcagaaccgctgatttgttctgtgtcagaccttcccattcattgtcttgtcatctcccacagcctccagaatgggaaaatacacatcattgcatgaaagaatcagtattaacaaaacattaatgacattcccttccccatccctgtggatcaaggcaagaagggccattcgccgatgcagataccaggagttggaaggccgcagcagttttgaggcctgcgttcagtgtctggacttccaggtcaagttctgagggtctatggcatctggctgaaatccttgcttcagggaagcctcatgtcctggctcacatgtggaagggggcatcaggagccccctgggccctgtgaaggcccatagattcctgtgtggaggccaagaga

SEQ ID NO: 2477 - DNA, 665 bp, Homo sapiens
tattgggatctcattgggagaaagtctaggcagattcctgctctgctgggccttctcttacgccagtgtggacttcacgggatagggcagacagagtattcgttgcatttatttgttctatcactacagaagaagcatttcaaaatgtgtacaaaaggatactctattcctccagtggtacatcccttgttcacagctaaacagcaataatttaacatcatcatagaggcagactggaaatatgactgcatttctcatttacaatcctgtgcatgtactcgccagaagggcagctgaagacctaaagctgtactggatacaacagattcgacctgaacaatcaccacacacaacattataaaaaactgtattagaaagtattggaaacaatattgcatattaatatgtggttacacatgttcacagtgagtgccatcgcaccaaaagcattatgtgcttcttttttctgatgcctgtacatcttaaataagtctaataattttggttcatcttaaagtaaaaatacattgaaatgaatgagagagatctagattttaaaaaagttgaccattcattattgctggaactgaagaaaggaaggatacactggcatcacgatttgtctacataagtccagttcatctcgcgtttgttttggcaagaag

SEQ ID NO: 2478 - DNA, 1236 bp, Homo sapiens
acaacataaatcatttaatgtaacatttgcaaccttagaaaggcagacatgtttaatccaagtccgtttataaattccaatttcacatggattaaaaactgcagataaattaagtcacaataatatcctgtacatgcattaaggctggtgactgctaaagtctcttgggaatctacaaataggaaatcacacgcagattactgggtctgaagagtgtctacattgttaaaaaaatcttgcttttttttttttttggtgatgcagatttcaacagtaactctggaaaactgtgaaaaatgttatttaaaaatatatatgtatatgctactgcacagtttcaaagatgtgattcataaataatgttggctgcactgattaattttataacaattactgcacttccaagttgatgcgaacacgcagtgactcatactcaatattaggcactagtaatatccttcaggcgtactacagttttatgttagctgtattgtacatatatatttttaaatgtatgcatttatacaaactgtgtatattatgtatggggtgtcagaaatgtacacatcactgttatataatacacacatcattgttgtacatatgaggataagttttagtgcagaaagtctcattgcattgcattccatgtgttcaatctagtacacaatttgtcaactcttcagattatttttccagtacattcctcattagattgtgggtttcaagtttccatttgcaatttgaatgtttccagaaatctctgtcttaaccaaacctctctctccaggcacgattctgcacatgagtctgatctgtgtagagtagtatcatcaaaaatgccaaattttgatcaggaatatacctggactactctctttcaaaggcaattgaacatcgtgataaaggatagcatctattcaggtcatggaaggatatggtcagttgaacttgtgttgaactttggaggcaaatgtacgtcttcaaataaaaagacatggtaataaaaattatttgcttaaatttgagagtctctggaaggatatacatcaaactgtgagcagtggttgtctcaggcagaagggacaaccagggacttacactttctactttctacatttctgcactgtttgagtttttacaatgagtagatattacttttctaattagaaaacacaagaaaggtatttcaacttgaaacaaaactaaacaggccaggcatggtggctcatgcac

SEQ ID NO: 2479 - DNA, 1355 bp, Homo sapiens
aaaagttctctcccagacatgagtatattttaaagtacatattaaaagccagcagtttttttttaacagcaaaagccataaaacaagcagttctcaatttacagttaacatagcagcccatcaagtgctcctctcccttagcatatatggtactttgatgcatattgttgatattgacagtcattttgcaaataaatgttctgaaagctttcatcttatttaaaggagtaaacatggaaataaaggcaccattttaatcaggttattgtgataagaccaaaaacattccacaaagtgcatacctcattttgacttctctattaaatttaaacttgagttaaaatgttaataatttggctttaattgaagagagagttcattcagagaattacagagttcgaattgggatgaatccccagagtttatttaatctggtaccctcattaattggaagaatgtgaggctcaaaaatgaaatgaccacaagagccatgactagaatctcttcgttactcagtccagtgctctatcataccagctactttcactcttctaacccacagtttaccgtattttctaatacatgctagtatattgcctagtacacaacatcctttcaaatattctttctttattctccaattcacttttcaggagaatagataacctcaatcatattgattctcagcctaatggtctcccttacataaattataatgacataagcattttgtatcactttattgttaccatcgacctcctacagtttgggggaacccaatcattctttaaaacattagaatgacaactccagttgatttggcatattgtataggtgagtgggaaagacttgtcaaatcccagaaaggggcgtggcaccagcaccacccaaccagaagaaaaatctctctttggtgctagtgtcatagctccctatctgttccgctaacccattaaatgatgtggtggaagaggatcctttcacaatctttgttcatttttttacagagcaaatggaagtcatacataaccttttacaaaattcattttttgttttaatttttttccaggtatgtgatatttgtgagacatcagaaaatcaatttatatttttttcctctgttaaaccaagccccacaaattgaaacctgacaggttagaataagttcttaaatatccacccagcctttgaattcttttgcttctagtgttggccaaaactgtctaaatagtacagcttcttctctaaggtagatggaagagattatcacaacagctcaacccactaaaagcatttgtattttataaataccagtcagcaaagacaaaaattaagatattcattttttcaatgat

SEQ ID NO: 2480 - DNA, 552 bp, Homo sapiens
cacattttaacaacatggagattttgttattataaatttcaaaacaaaatgaaggaatttccacatatttataaccttcaaagtacaatattaatacatgtctgtcagttagaaagaacagcagtttgttaggctacaaggtttaacataaaaccaatttacaaatgtgaaaagcagtagtggtccaatattcaccattacacatgaatctgtttcttccagaattttttaaaattaaaattttagtatcgtgaaatattaaaataacaccccaaacatgccacaatcactattcacaaataaagttaaaatgaaatatacaaaaatccacttaatactgttaaataacaacaataaactacaagatttcctgaacagaaatggtaggacccctgaatgttttacagtgaatttcaggaaaagaaattaagttatgactattttcatgatatataaggcaaaaatttacacgaccatttcaaaatataccaattaagatttatagtttgtaagatgcactaaacaaatagtccttaaaagtgaacaaaaatg

SEQ ID NO: 2481 - DNA, 558 bp, Homo sapiens
agagtttcacaaataacatttattgaccacattcataacagaaactcacccacattcacatgaactttgctacaaccaagaatcacctgatgagaaatcatttgggttgaatcctgggtgtggattctgttctgagaagacagcgactgtcacagacgcctcctgattggtggactctcaaagatcttgatcgtgacacatttttgtggctgttcttgacagtagctgaagattccaacttcaaaccccaaaacactggcgaatggccatgatgaccctcgggatggcctggaggagggtcaggaggccgaggggcagcagacgcgctgcaggagccggtagctggtcctggtagggggcctggagctgctggaacttggacaacaggcactcatcaccgcagatccgccagcagttgtgccagcagcatgcatccagcaggggtgctgctttcggggtctcagggacagagggacccagtaaggcagtgctgcttccaccctggacacaggcaggcggcccccgaatctggtctggcattcacagcagatggccagg

SEQ ID NO: 2482 - DNA, 451 bp, Homo sapiens
cagctagaaataagttattttattttaaaacacatacagattaataaatattactggaaaacttaatagcctttttatttacatgaggcaataacaacatgctatgactacatctataaagcaaaatataagcaggtcttggccactgacacatgtgtctatgtatgctaattggaagctccccaatacatgtctatgacaaaacttttacacaaccaatcaacatttgacattttttacatcttcttcctctcatgattatattccattttcaagaaaataatagttatcctttgaaaaggcaaaacgctcaagccactgaaaaacagtatctaaatttctgtaaagtgcaaaaatactaaggtggggggcaattattatattctgacaaataaatattctgaacttttcaacatgaccctttggcactagtggtttgggagccctgaca

SEQ ID NO: 2483 - DNA, 447 bp, Homo sapiens
atgttacaaatattttattgcaattttttccctttaacaatgtctggatattttggaattaatatctcggacttctttctaatccacattggttcatcttgttcattatgaacagaggattctactttacaatgtactaaaatgttgttatgtatttcaggaccattgaacattcaagttgtttatcattttctttgaccaccaacattgctgtaatgaatagggatttaagagcaaaagtaacgagaatacttgcttaaccacttatgaaaacatatcataaaagtagaacaatcaaaatggtggatgccatagagaaagcaaggtaacaaaataggaagcctagggaccaataaagtatatatacaaggatttcctatatcacaaaagtaacacttcaggtacatggaaaaagaatttcagtaccaaaaggcacctcagtctcac

SEQ ID NO: 2484 - DNA, 463 bp, Homo sapiens
gagaacaccaactgtttattacaggaattcctatgaaacagctccaagaaaaaacccacacataggaggaaaaaaaataacaaagcaacactcaacagacatggggctggggcttcccccacagtgcgccgggtcctggcgcggggaaggctcagagacccgtcgagaactcgagctggggtaccgaggcactcctcggagacccccccccctccctccagggccccaggcctggcgcggggagcagcggagggggcgaccgctcctcggcagggccccccgagccagcgtcccggccccgcgcgcgtttccaaacttggtcacgctcggcggcggctgcgcgtcccggccctccccaagctcggcgttgcgagtccgggcagggtgggcgggacgaggtacgatcgccggctcgccttcgctacgcccttgtgatcttggggccacggaggccaccagggcc

SEQ ID NO: 2485 - DNA, 573 bp, Homo sapiens
aaaaatgttagagaagaacatttattgacatgaaaaggtgtttcagatatactgatatgtcaaacaaatagtaaaacaacatagagtaatgattcattttggtaaaaaatatatatgtatatatagaaaaaaaaattctgcaaggacatatgctaaattggtaacagtgcttacccctgggaagggggtatacagatgttgatttactctttgggtacctgtatttcccagtttttctataaatcacatcatttgcttctgtcataagaaaaaataatatctattatcatcctttattttgatcaaaacaaatcaattttttaaaaaatcttaggtttttttaagaagcagaaataatttccaaattgcctccagagacaatgattttatcctctgcagaagctggtcagaaccttcttgatcacagccccagttagatacagggaagaatggcgcttcctacagcttcagcggcctcagctcagctctgtgccccaaggccaaaccagctcatctccagccccatccatcctattcttgctgagtcaccagtctcatcatcttcagagccat

SEQ ID NO: 2486 - DNA, 735 bp, Homo sapiens
agtgcaaacaaacatttattgtgaaatattcatcctaccctttattaggtattacatcatcaaagcactttgtggcaatgaaaatagctttttttacccctctaattcacccaatattccattaaagctgcaaaaaatgtgcaatctgcttgaaaaataggttgctcttatttactcatttgtgaaaagtcaaaaattaaaaaagaaaatgatactagcatacagggcctctagagccaattcacctttccatttcccaactactccccaaaataattaacaaagataatttgttttaaatgcctttttataaaaccaatgcacctttccccatattataatcatacaaattttaaaaagccgttatttactttcttggaaaaaaggtggccagccgttgttttttgattgggagcatgtgtatttcctgggagttcactttctttaactttatgctccggtttttgatgggtttcctaaggggctctgcatttcccatggactcttccccttggctgttgatgtcatagccctgaagcacggagtcttctcttttgaaggagaagtttttggtggacacccctgagaggcctttgatcttgccacagaatatggtaggcacagcatcttcgacagagacaatgaccttggccgcctgggactcgcccaccatctcaatgttattttcagccttgacttcgccgctggggtggttgggctggctgagcatctcgg

SEQ ID NO: 2487 - DNA, 652 bp, Homo sapiens
gcctttaaaatcattttataaagaatggcacaagttggggtttatgtttactcagatgaacccgtccccttagaggacacaatcccacccccaacccccccaactccacgactgcccatcattgctgttaatccttcaggggagggttcacagctgtttatgaagccaagagaggttctgggcaagatcacagctggggaaacaggcccaggccctgctccctggtgtcctccatgctggagtcagcggtgcccaatgacggggtgatgtgatcacatctgcttccttctccacaacaagagcagggctggcgggcaggccaggaaagtcctccaggatctgatcttgccctccgactgaccagtgcgagcgacttctgcttctcttgggtcttctagtggtagaagacagctggagctggggtggtatttggatcaccccagacccaagatcagtggactggagcaccatggaaatgtttgggagggtccctcaggattgggactttcccctgaggcctctaggctcctccaagctgtggcctcaaggataagagagattgtgtcaggttcatgtgtctctggaactgcatgattgctgttgagtctgtatgtgtttcacctgtgtatggatatgtgtctctgatcagatt

SEQ ID NO: 2488 - DNA, 1071 bp, Homo sapiens
acttaaactggtcttgtagtctttattgactgtttgtaccaaattgactccaggagaaatggaaaatctaattagatctataactcttcaagacattgaaattacagctttaaattttacaataaagaatattctggccaggcatggtggctcacgcgtgtaatcccactgcactccggcctgggcaatagggcaagactccgtctcaaaaaaaccagaatattctaggctcaaatggtattacagatgagtctaccaaacattcaaggagcaattaattccaatcttaaattcttcaaataataattaaaaaaaggctgggtggtaggcacatgagtggacatattatttgttaatccttttgtgcataataaaataattttttttttttttttttgagatggagtctcactctgtcacccaggctggagtgcagtggcacaatcatagctcactgcaacctctgcctcccgggttcaagtgattctcctacctcagcctcctgagaggtagctgggagtacaggtgtgcgccaccctgcctggctattctttttgtatttttagtagagatggggtttcaccatgttggccaggctggtcttaaactcctgacctcaagtgatccgtctgtcttggcctttcaaaatgctgggattataggcgtgatccactgtgcctggcctggtgtttctttaggtataatgtctttaccagagagctaatgcagactgtcatgggtgagattgttctctgatgttcaattcccctactttgtatattgagtcagtatgagatgcgatttgtttggcaagcacctttgttcctgctgttactgacccttatcttgtagcctcacagctactatgcttttgtccagtccaactagataggagcttcttcctctgctgcagtgactggtctcacccagggctttcaggaaggtgagaataagcaccttcctcctcccaggaagttttgagtttcctgtgtttcatttctgaatgtaatgtctccatttattttcaattatgtttgattatatttgattaaaaacaataatttttttggc

SEQ ID NO: 2489 - DNA, 689 bp, Homo sapiens
gactcttccctcctcatttattttggaatgtgctagaaacagcttgaaacatccctttaatagcttcctggcctcacgagtgttgaatgacatgacgaattctccttcatagaaggtacaggtgaaccagaactggaggggcatttgggatccttccttcttcagaaagtgcgatcgcatcaagatgcatgtggttttcagtagaactggcccatgtttcttgggagcgaggtgtccaaaccactgttcatccatatttcctgaatgatttgctccctgcgctcaatcctttctgcgagctctgcagcttctatggaactgtatataggatatgaagtcctacagaaccccgacagttcccctgggaaatcagactcagaggggtcctcctcctcttcttcatcctcgctgtcctcctcgaccttgtcacttcctggcaccagctgctccctccccagctgcaagtcgcggaagtccttggcacaggactctctgatgaccagggcgcacagtgtgagggccaggccgatgcagacactggacacgaacagcagggcagctctctccgggtgggctctaatgtaagcaaaggctgccagagagttgctaacaagaattccatctttcctcagaaccttcgatccgcttgggtcaaagtttataccatattcaccatctttctgcttcaa

SEQ ID NO: 2490 - DNA, 1307 bp, Homo sapiens
ataataaaataattattttaatgaagtatttggaataattttaaacatctgatcagtaagattatacacaaatgagtatgctgcactttacaaaaaataaaggtaagcatttaaatataaaaaaacaactttggataaagatctcttcttaaagtactcctttaacatacacataatttatagcattttacataacttgctgaagcaaaaaaaaatgtggccaatttaaaatttactatactgtagaatatggccataacagtcccaatgggaagaacaggatgaagaataacatacgtgaggtgttttttttttttccttcaattcttataagtatagcatttcccatttttgaaataccttcttggaggattcaatcattttttttctgtatgtgattctaactacagtgattatttttcaccggctgtattccacacacgtggaattttcttttttttttttttaaagagggtttgctttgtccgtcagcttcttcctcaggtgaacacatataacttgcttctcatatttagagctcatatccccaagagtgagatattgacagtaccttttaagtacagaatccaacataaagtcctattgttaaaaatttctcatcatcaattaggattttttaaatgtgccaacatgcttaaaaattaggataactaaaatatattatgacagaaggaactataaaaactatccttgggatttaaaacaatacaaaacaaaaaataacattttccttttgaaatactctaatttgaaaacatctggtacattctcctttctggttgtgctgtgatttttttttgcccatcaacaaaacatgtaccagttgttttggagttccgattccacctcttcccctcttgggcatatgaagcacatttcctgttttatgataccattttcacattctcctcatcagtttgaaagcaacgccctaacgttccttctaatactttgcaccttttccattttttcaacaagatatatcagtagattcaattttaaggtttccctgacaagcatgtcccctcacttggtaccagaaacggcatatggtgatatgaagcagagaattagcaaccccaggcacaatctatccccatttgtcttgttttgacaacactggaactcagccgaccaaagtcaccacagtggcctgtcacgtacagagggtgactgtcatagttagctaagcaacttctgattccagcccagaaaacctaccactttgggacaggttcaatatagaatgaaatagtcattcttgtattttcttatgcctcttcctt

SEQ ID NO: 2491 - DNA, 442 bp, Homo sapiens
cattacttactcagttttatttaggtggacacaacagtgaagaactcaaacatggtttgacctttatctacagacacagcagcctggattttcagcctttcattccttttaaatgaaagtcagcaggctcaaaatgcagagcttggctaagtcacttctgtggaaatatgaaatatagtagtgataaccaccaagggctttcaaattcttgtgttcttctaaggatcctttcctaacaccatgatttgttctcatctttgtggaaatgaaaccaagatggtcttaatttgtaaagtcctttttcctctgttggcagtcttcttacaaaggatgcagcaaaaagaacacatttttctttcaaagttttgaagaaatatagtcattaaaaagaatttaaattatgcctagagcaccactttacagaataccattaaattgtaat

SEQ ID NO: 2492 - DNA, 1156 bp, Homo sapiens
taaaagtttagttctaggtacaaattaagtggtctacccaacaggaagctgtgaaattagaagtaattttaaagcatactttacacctctatataatcaaagtaagggcaagataaaacttgttagtaaaacatgttttattattttttagataggtagcctgcaacataaaatatattttgaaagctgttaaggggtgtataatctgttaaaaaataccatgattagtatttcacatttagtgactcagatccctttgtgtaagtcctttgcgttgtgcaaagaggtttttctatgagatgagaattatgaacacttcatataggtaaattccataggttgagctggggcagaaattaatggctcctggagattgcatcttttttttttttttttttgagcttagaattcccatttggacagaatttagcttttgtgctgttgattacttctgtactaaactggtagccaattgttcacttctaaatggaagggaaaaagttacccacacaagttagaaaatgatttaccgaattatttttttgagttagtatgtatatactgttttaaatcagtaatgtttgttccttttgctgcccatttgggagtatgtggcaattcctagtgctcttgtatgacattactcttcttgagacttgtatatgcaagaaagtatatataaaagatgcctggtggtaactttgtatctgagttctgattcattatggacttttagaaatctatttagataattggttcatactaggtgctcaattactctgaccttgtgtggcttaatccttaaatagttgctttaggtgttactgggtggaagcatggaaagtgaagggctaatattaaggatttttatgtattactgagtagggaaagtgggaagtagcttatctttggacagttgtattactttgcactaatcaccttgtttgcagttgtagctgattcagttctagattttaggaccaaaaagatctctaatttaaagaaacagtttttatatacctagaatgaagattctgtttaaagcggttttggttaacttggttcttgacatttgcctaaaattttgttggattgggactaaaatgttctattagccaatgaataacgtccaagtaaatttttgttttattttggg

SEQ ID NO: 2493 - DNA, 615 bp, Homo sapiens
aactgttatcagactttggtttattgtaaaatttagcaaagtttttcttgtaatccctgacccattgctctgaaaacaaaagcaaaaacataattattgcttattcttttccccctactttgtttgtgctactgtaaaagaagggagaaaatcattgtaataaataaaaaatagagatgtaacagagaaaaataaatcagctcagatgagaagtattaggagcaacagcaataccattaagcagtttcaaaatcagcttcttttaaaaaggtcatcttattaaaataaaaatcacaccaaaaatatagcagcggagaagaaggataaatacaagttcattgcacaccagtcccatgcaaaaaactgtcactagccaaagcagtagtattcagaatccaatttaggacgcttgtgtagtgcctgtgagtcctctatgagggagctgtcactgaattggtccaagtctgaaggggtctgatggcctgggacatcatccgccaacgtgtccagataacttcccacggaaatgccatccagcccatcactgccatcgtgtaggctgttgtagctgccacgtaaggaggtgctctgactctccaacaaactgcacaggct

SEQ ID NO: 2494 - DNA, 1270 bp, Homo sapiens
cttggactgcagctagccagcatgctaggctgctcattctatgaagtgtctgtcagtgaaaattataatgatgtctacagcgccttccacgtcctctgtaaagaggtcagtcacaaacagcagcctagcagtacacccgagaagcgaagaacctccctcattcccaggcccaagtcacccaacatgcaggacctgaagaggaggtttaagcaagccctctctgccaaagtgaggactgtcacctccgtctgaagcaggaggagcactcaagggggtttggtcttcccaggaagagggcctgaggttctcctagtgcaggaacgttgaatattggcaatgattcctggttccagaaagggctggagcagaagggccaagagggcctgtggaactgctacagaaaaggaagtgttgttctgagcagggggacaggattgatgaggcttgaaagagcccactgagccactctctgaatatgtgaaatgtactctgtgtcttttcctttagagtggggagggggcataatcgtttcggtttctgcattcaactaccttgtaaatggtggtccgttgcagtttcaccaaatgtattgatgtgatttacagtgggaatgaaagaacagattaagcattgataggctttcttttttcccccttttttcttttttctcttttcttctttcttttcctctttttccccaagaggaagaattgcttttctcttaccagtatgatttgtaactctggaacactattcttacagaatgcctttctaacctgaaggatacccagatttctttctttatgtacaagatggaaaatcccctacccctcaaaaacaggttgagtttatgggccagaatattctgtataccagacattggtaagctctcatggtttacaggaaggctctggttccccctcacaggatgagcatgctcagttgggcgtgtgtggaggagctgtgaacttcacgctcttcaaccccagactttgactgtatagttttttgtttttttaactgttccatcaggaaaaaaatgtgtcagttgattttggtgtgacttgtgtaaatggttcatggcaatgacgttgggttgcttcctaggcctggctgagttgtgcctaagggtggctgaaatactaaaacactatcttacagcaagtgaacaggggctacctgccacatcccctccacagatgcactttaaaaagccactcaagctttggcttaaactgtaattaatttattttatgtacaataaatcgca

SEQ ID NO: 2495 - DNA, 1207 bp, Homo sapiens
tctttaaataaaaaatccataaatttattgcaaatctagaagtaccagaatgtcactaatacagaacagatcagcaatcttgtttgtattttcttccaaacatttaaaaccttgattattgacatactgaaattggcatacattttgttttcatgcagataacagaatagacatggagcagatccctcagaaatcagttataaatattaaattgtattgaacattcatagtaaaaaatatgtcgtaaagtgctgaagtcatgtaagtctgcaaaactgccacaagctcaaagttctcaagcagtgacagagatttgctacatccaccttgttttagattatgcctgtttttgacagacactttgtcatttcctcccccaccctccccaaagttttatagattgtcctatttctatggctgataagatgctctacaaaatgtagcaggtggtgatgaactatgccactttcatttcagtgcagagaaatattcaagcttgtgtgtacctgtaaccaaactaggcttgttatgtttttccccctgagttgtcataaattaacattaacgatgaataaagatggagcagcaagcattgaccatcacctgcagggtgagattgtggtaaaataggtgagtaaaaagtccacctattatcctgacacttgccctccttacagaaaactgctaacgtgagcaatactatacatgtagtgtgactccaaaaaaaaggaagaataaaacaaacaaaacaaaacaatgaccagttacccgatacctctggcaacttagaccaatcaagtcatgtgttatagaagatgtaaattgcaacttgtaactcgctataacataattgtctctgttacccccatgtgaaatacagaaatgcttcaataattagatggttttttctttaaatcagaaatgctttaacaattctctgaaatataattctgatcaaagaagttcctcaagtattcttaaatgataaaacaaattagttttgaaagctaaggcgatttgcaatccattattttttcccctttaatagcacacgttgcccctaatcaaatggaagaatcatgacaacttggccttttatgaaagtatttttacaagataagacgtattctgtgaggcatttaaaggattgcagaaaggaggtaaaaatgctgcttatgtctcagattttatttcttttgattacttt

SEQ ID NO: 2496 - DNA, 622 bp, Homo sapiens
actgtaggacttatctctttattacactaacatgcactgtgaatctctaagaaaaagacatcatgtgtaatctcttccaaagcttattttaataggaagtctttatgcatggcatatgtcaagattaatggtacatggaacacattttgtatcctatccatgagtcacacgggaaatcaccttccaggcctttctctgtgaggtctccctgtccactgtgccctgatcaaccctccaccccttcactgtctttacttccctcatttcccttaagcagacaaaagtccaggtctctggtccacagcttcagacatgacaaggaagaggcccagtatcaaggtgaagctgaggaaggccaagggaaagccaggccaagaggcacccgttggtgatggtcacaggagagaggtgatcagtggagccaggtactgggccatcctgctatagatcacactgctgagttttggttgtatttgttttagaagcagccatcattcaccgagggggagagaggaaagggaagagaggggaagagaagaatggggagggatatttacacgtgtgaagcaaaggccaagccagaggctgaaagccgccaccccctgacaagcctccacctgct

SEQ ID NO: 2497 - DNA, 609 bp, Homo sapiens
caaagcgcgctcagcaacctcggctgtatttattgatacaaggaagatcacccgagagtcagggacgtggcggcgaggggccctggaaatctccagataccaaagctggaagggcgtggagtcttctccagttctcctagtttacagatgttgtgacctaggcttacaatgggcctggggtctgaaagcgggacgtgggctgcgggggtcaaagagccggtttggtggaggtcagcgccacagcgcgccgtgccaggaagactttattctgcgcctccgtctctctctgacgtttgagctcagagatgaggcgtccgtaggagttagccagagccacagtgtacgccatcaggatgctggagatcagcagaaggggcacagcaaaagcctgggtccccaggaagaagaggaaattctgggtggtctcagggaggctggaaatagactcagggatctgggcccagatggacgactgcccccggaatggaccacaaagcttagaaggcgggatcaggaagatgctgtaaagcaggggaacgctggagatggccagacccaggagaaggaccaaggggaaaaagaaattcgccgcggaggcccggaaggtgc

SEQ ID NO: 2498 - DNA, 661 bp, Homo sapiens
gcctttacagatatgtttattagacacaaagagggttcatagatgacctaggtcaaaggctagaacatgcagacatacttttaagaacaataaatttagaaatgctttgaaacaaatgacaaccacagatataaaaaagtgctttttaatttttagccagaatggtcaagttgatgtagattttttttactggaatactcataataatgtctgtctatatgccttaagcaagattattatttaataaaagatggcaggaagttgtaatttatggaaaatttacaattattctttaaaatacttttataaaattataaattgataataatccccccaaactgaagtgaaatacttttaatactacttgaaattaaagtacagttgtttatacaacaatgaataaggacaagatatcaaactgaaaattcaaaaataaacagaagaaatgtaaacagttctaaaatatcagtatttataaatgttgcttagaggaaggctattcaaagcatggtccattaactatttgtgagctgtccagaatgaaagaggcttgtgccagaatgaaaatcaattacatcactaatcatactggctcagttgactttttttaaataacaagacttctttgataaaggaagcaatgtgttgatttatattctgg

SEQ ID NO: 2499 - DNA, 514 bp, Homo sapiens
cattagtactttttgatgtcaatttattatttatccctttgccagtattcaaacagacaggcagtcataaaacattaaaaaagatcctttaaaacggtcaggcatctgttttacctcagttcctttttagaaacctggaaatcaggagccccggcttttatgctatagcaagtttgacacttgctgtatcaaaaatattgcttgaggatcactacgtagaaagagttttgtttaaattttatgaaaggctggttaggcaggcagacaatggtttctaaggcaagatccagtgtaaatcagcaatgtgctgtttccaactgtttgactcctcagttcatattctgaaaccagggcgttgacaaaacccactgttcagtaattagcatcctgtcaaatctttccaatcaagactagcatgctgcacctggtcctagttaaaaaacacattgtgggcaattctgatctgaccctcaggggccgctgccatgctcagaactgcattcagcgtgcatgc

SEQ ID NO: 2500 - DNA, 1284 bp, Homo sapiens
gcccattcttcacgcagtgtccacgtgcgtctgtctcgtggatgcaggttcctgttttgtagtaacgcaggtggtacttgcgttctgtgtcccccgtcgtccggtgcaggtagggacacagaatgcacagtggagacccagctaggcacaccccggacccatccagacaggagttctgcacctgccggacgacagaggcctgtggaggcgcacagggcaagcgggaagtgtcaggtctgtcaggtgacaccgccaaacagagctctgtgtctgtgtgtcaatctggaaaagtggcaccacaggaatggggcaagcctgttttttctgagaacgagacccagggtggctgcagggccacagtgcaggagcgctcttctggacaggggtgggctggcagatggccactcgttctgtggctacacagctgcaggccacgtgtatttttttttcccaatgaaaatgggcctagaggctgggcatggtgcctcaggcctgtaatctcaggactctgggaagcctagcgatatggatcgcttgggtactccggagctcgaggcaggagaatcgcttgaacccaggaggcagaggttgcagtgagccaagattgcgccactgcactccagcctaggtgacagtgcgagactctgtctcaaaaaaaaaaaaaaagaaaaaaaatctttatctggatctgttaaaccatatattattgatcattgcaagtgaaattttgagagattgtttctagtatttaggtgatgaaaacatttggtaatattgctttggttcaaagaattttatgtctttatctttctagaagaaagcaattatatatatatttttgctaaattacataaacatttaattacatcaggttctaatttaaacatgtattactcacttgaggccacttttaaatattcatactctttgacataagatgctttgtatatttctcatttcttttagttcttagtaagtcagctttaaaaagtacctgccaaccagaaccttccatattctggactaaatcttgctcttcggattatacttcagtgcagtaactgtggatttgcaattttgaaggggagatagtagctattatattttacacttgcttgatgtgataactctaaagactttttaactgataaaagcgcacatggctattttgatacacaaagttgtgtttgctactttagaagcttttgtggcagaattgtaatctaattttcataccttgtatttctgaatcacaacaaaaaaataaatggggaacaagactta

SEQ ID NO: 2501 - DNA, 930 bp, Homo sapiens
agtagtgtaaatagtttattatttgctcatatgccatgaaaagaccagaaaagtaacatgaattgcttttataaaacattctaatattgctaagaagcaggcccattaatagacaaacagaaaagaacatgccaacgttgtctatttgtagattaataaataggcaattattttaatatacatatatgtcagcattgaactttggaaaacagctgctttgtagtggaagtccaacttggtcaaattgctatttttaatcgaagtgaatgttgagtccacagaaagacaaaatcgtggcatgttctttttaaagtaaagtacacatttatgggaatgtgcccgcaggtggcagtttaatctttctgtaaataggtacactaaagtgaaatgtggtaggtaacttgttccctaaactgtccttatagttaaatatatatattaaaaaaaactataagttaaaataacattcagattgtatagcataggctgatgcattttaaaacaatatttacaatattacccagaggcttaggtgggaattaaagagaagtgtaaaaaccataaaaaactgcaccgattttatagcaaaatatctgtacatttaaaaagatcatataactacacatccaaggaaaagggaccttcaccaaggggttcacataagcacaacataaaataggaacttcagcggttaaatactatacaataaactttacaattaatatattgatgtaccaagaagataagccagaagcagaatgtatattatgaaaagtacaaatttagcttcagtccagtttttgactttggaatggatcaagtgccctgccagagaggaaggaaaataacagtggcttagtgggccatctagtcccattacgtattatttaagcttaataccatgttaatacttttcagcaacttaaactg

SEQ ID NO: 2502 - DNA, 572 bp, Homo sapiens
gggtttccacaaaggcttttggttttattattattatttttaacaaacatacattggaaatagtaaaggtttctaattgaaaagagacctaatgcatagtttctctgcagcatagaagaccacctgtttccaaacttcaaggttagggctttgaaacattccctggtaaattatctccagctggctagctagttaggcatattggtgcacattggtatcaaaggtgattattttttgcatttagcaaatgagcgctattacttttttgatgtatttttaattcagattgctcaaaagtcttgttatttcaagggagccttatgtcataccacaaatattgatacctcctagtggaaatggtggctgtgggctccctagtagagttaatggatgaaggctgagatacttagatactgcggacatcagggttatggagcaaagtgttatgaacaatagctacagagagctccaagtctcccaaagcaactcataactataacacagataaagttccaaagtcatttcatcacctatgtgaaaatgcaatactgaatgttttggctctctgatgc

SEQ ID NO: 2503 - DNA, 511 bp, Homo sapiens
aacagtttttcacaacaaaatttattagaagaatagtggttttgaaaactctagcatccagtgagaactaccatacacaacattacagctgggaatgtttctccaaaatgtcatggtcaaataatacaatggaaccattaaatcttacacatgcacgaaagaacaagcgcttttgacatacaatgcaaaaaaaaaaaaaaggggggggaccacatggattaaaattttaagtactcatcacatacattaagacacagttttagtccagtcaaaaatcagaactgcattaaaaaatttaatgtagtgcaatcaaaccaaaaaacttaatttgtgatcataagtgctctactacataaacattgatcatagcaaggaacaaaaagttcaaatcacacagtacaaaaaaatctgtaaataaatataaactacagtacaagagaaatattaaattatacaattccatcaaactgtaaacagtatattgaaatgaggtccataagagtaaaggggg

SEQ ID NO: 2504 - DNA, 842 bp, Homo sapiens
ctaagatgtataaatgacttacttttaataataaatatttcttgatttataatgtaaatacaattaaacaaatatgggttactcgaattaaaaaaatggcacatgtaaatgagcattttagtacaaataattaaaatgtatttatattatatagaaatctacacaatggaagatactactaaaatgttgctctacagcacatcaccctagacaaaatagaattctagaattctctttaaaaaaaaaaaatcactgagaattagatgatgactgtgaaataggttctcccattacaatactacttctgtcattcaaagttctgaccacggttgtagctggcgactgaagcacttttcgagaaagcctcattcttccatcggctgggtcacgtccaaagtatttcacctgaatttcttggccaacttctaatcctagggcagtaggatgtttaatctttcgttgatcaagttgtgtgttatgaagcagtaccgcagtcatatttggatataattttaccattacaccagtatctctgatttcagttattgtggcggtatatactgctccaaattctaattgctgctcctgatcatccttgcagatttcagtaatgaagtctcttgcctcatgcatagcactgggtgttggtgcaaatacagaaaacgtttcttcatccacctgactaatagttacacctgtttcagcctgaagtttttttaagttatagccaccaggtccaacaaattttgctcgttttgataatggaacctgaacagtttctacaacaggtccattttcttttctagatgctcgaggttttgaaatagttttgttcatgatct

SEQ ID NO: 2505 - DNA, 518 bp, Homo sapiens
caggatgtgacaacgtttttaatgcaaagtcaaccattagcatctttcccatgtacttattagatgtgaaatggcaggacttcacggccccgtttgcatattttcctactccgcagacgaataatattttcagggaaggcagcgcagtctgtgccgtcacaatcgggcgactgtgggtgatgagggatgatgattttccaggaggccctggggtcagaggactcctagagggagtttccagcccctcaatcgcagatggatggcctgttgatgttgtaactggggtggaagttgagccggtcacaggaggtgatgcagttatcggggccagtcacgatgcttttctccaggtaaacattgagagtattgttccggaacattccacccgctgcaagttgttgggaaaatttattcgaatttggataaaatactttaggcatctcgtgcacggtgggggctctgctcccgtaagcctggttactggtcctgtacacggagacagccttctgggtcctgta

SEQ ID NO: 2506 - DNA, 430 bp, Homo sapiens
gcaataaatgcccatgtttattacaagatagaaacattaaagatttcttaggcaaaagggcaacaggtatgaaagtattcacagggcgccaaatttacaacagcttgctccaggcgatttacgtgaatcctggcctgtcccagcatgaggccattgacaacctggcgcctctgccaagcctgtgtccaggtgcctggcatgaccaggcgtgatgcccaccaccacagtccctgctgcatctcagaggccggggacctcccacacaaggatctcgttgcgggcggccgtgaagagcagcctggcggacggtgtaaacctgcacaggtgcactgcgttgtcgtggccggcaaagtcttgggcagtccccatggcacagtctaccagcctcagcatgcactcagcaaagccaacagccaggaggtgggtcccg

SEQ ID NO: 2507 - DNA, 958 bp, Homo sapiens
ggcttaaaagatatcatcaatcttttatttaactaagcactgcccttcattttgaaggaaatgatacaatttcaaatcggaacttccttctcaagaagtgatataagaatgtaacattgatttaacatacaaccttcaacaaaaataaagtttatacaactcactgggaaataaaatgcatgtggaatttatcctgtttgtcaacataattcttcatgagtcacaagtattatagccaagaacaaaacaacaaaaagctgaatcagttgatagttactctgatttaaaaaacatttcacaaataagatgtagctttccaaacaaatccattcgatgaccattatcacaactatattttattctaatttataaaacaaaaaatggttagacaagcacatgatatcaagagtcttcaacacagtggattccattttattaagaaaaaaaatagaaaacaagtagtccttaaattgtcttagctctccatagcatacgttatataaaattaaagttttgcttccaaaaatatgtttccatgtggtcgtggtgttgtccagtgctattagggccaaagcaccaaagacatgagaagtttaaccatcgacttgtcatttttcataaaaactaaacatttccttataggtctggagtaaaatcttctaggcattttagtgctaaaagtcactttaaattaaatgtgaaataaaagctacaaaaagtatgagttctttcaatacaaaaagttgtgtagctgaagttgtgggctcctttgacatacataagcagtttcaataaaatatttgctcaggtaagaaaatagaaatttgtctgctttcatttagcatacgttccagtcgatgtcctgcttatccctgccagaacttctgaagaacattagaatcgatatttctttccttcaaagagcatccgtaattcacagtacaaaacagttctacag

SEQ ID NO: 2508 - DNA, 636 bp, Homo sapiens
gaggcatacacatctctttatttacaaaatgcggtgaagagaaaatatctagatatttgggtgtaattattccaaacatagaaaacacacaatagaatcaagtgaagggaaagctactgtaacagcttagatactttttaaggagaactgatagtaaatctgggaatgggaaaaaaacacagagctagaatttgtttagcactccgtgcaaaaggcaaaagctgataaaactggagtggacggaggctccgaatgtggccctccgctgctctctctcctgcagtctcatccccggccttagccctgacctctcctccgaagcccctggtgaaggccgcgatggcaaccacctgcaggacggcctccaggccgtgaagggccaggagcgtggcgctgagggcccagtccgcccacaacactagggcctgcaaagcaggaagtgggcagagaggagggcggtgccagccgtgagggccaggctggcggcagcggcctctcagcctctgtcaggttgccctggtgcccaggtataaccgaactgcttctagaatccccatcagaaacagcagagcaagatcgaggaccaggtagcggtgaggatagctgaacacctgacttttatacgtgatcatcagg

SEQ ID NO: 2509 - DNA, 640 bp, Homo sapiens
aaacgttaatgtgatctttattatacagcacatctggtatttgtgtatcccaacaagtatacagaatactctataaaaccaaacccaacccttcaatattacactaatgaagattaacccagagtcgcatctcttcaaaatgcacacaattaagacggtcctgctgtaacaatattatggaaagagccaggtagcacaagaaaggagagaggataaagactgaagtgtgtgccaaagtcattgtcttttgttattgcacttttattctacacacttagtatcttacacttttatttaacactgtaataaacattagtcctttaaaacaaagaaaaaacattacatgaagacaaaagacaacaggctgcccagaccaattttcttttcaactatctgggcaaggtggcctccccagtgctagatgtcctgatgcacctctgagatcacctcaattggactggatgttaacaaaacagatgaagttaaaaatgaaacccttttaggaacagtagtgctactggaaacctccaggagagtttggaatacaagtgtctcaaggccactccctccttacccactttaacatcaaacaagctctattcatcccacctccataactgaaggattaaccttctttttc

SEQ ID NO: 2510 - DNA, 557 bp, Homo sapiens
ttgcggttctgcaaactttttttaattttaattttatttttttacaatgtaccatgaacatcttttccatgcacatgggtgaaaatcctctactaaaatatagagcgccgtagttgggtcaaaaggctgctggtaacgagactgacatctaaagcaaagtatcagcttaaggttaaagcattgggcctggcaaatacctaccagggaaagcagggccagcaatattctcatcagagaaatcagaatggaaggccaaaggcattaaaggtatgggatatcgtgtaagcccctctggcccctacctccacccctcactcccctgacaccccgttgtccccttggggcgaatggatcctgtacatctctttgcatccaatgaaaaccacccattttctgttttttccttagctcctcttgagcccttgacacatctccacattctctcatcatctcctcactgctcagatgcctttcctgtaagtcctcctgagagtccttgggggaatcgtccgtccccctgtccgtttttctttttgctttccggggcacataatctt

SEQ ID NO: 2511 - DNA, 1098 bp, Homo sapiens
gaagggaccaatggccagcttgctgaaatgtaatgccattcttaaaagccagctaagaatcagaccgtattagttaaggacccataagagtagacatttagaaaaagtgaaaaatggcaagagtggcccaatcttttgagagtttagagaaaatatcatttggaaagggagtagctctccttctattttagccttattattacggtatctataaagcaatgccatattctaaatctgcagaaataaaattctaaggggcgaaagtccaaggcagaagtcaaaagttttgcaaggaaaccgatgaggttgctgacctgagctgggcagggttgaacaggcgagtgccaagatcaaggtctctgattgtctctccttgaaaggtaagcagagaactagggctatcccataaattaagtgggagattggaaaggggtgcggacttctgtattggggagaaggtcttggatgaactggggcagagaactgccagagagagtacctaggaatacgttgttagcaggagaaagaccaagttcagatgcagacttgggaaagtaggtaacttgaccaaaggtagcaaaattagactacccaactggattgtgaatgcagtttatgaaatggatcaggacaggagcaaaaatagattttctagaaactgcagactcctgtgattggagcagtatacaaagtacagcaacatcagactagatctcacctgaggtgctgggtgagaaatcttagggaccagatggaagagggcctgtgtataaagacattaggaaggaggtttgggagggcagcctgacttgtctccagagaaagttagaactggttgacttagcaaccaagggacactgggtcaaagacgaggaatcaggacgtcggtgcctagtgactgagcgccagcccagcccatttctctacattgccatgggctaaacccagtgtgctgtaaactcttcagttcctttggttatggattttgtatcttttctgtgtttcttaataaagttcttttgaaaaatgggaacctttctcagatgggaattttgtatctttcctctgtttcttaataaagttcttttgaaaaattgg

SEQ ID NO: 2512 - DNA, 825 bp, Homo sapiens
agttttaccatcttttattataaacaccatcacatttcaagtttcctctttttgatcacaaatataggactttttcttctcctcttaagtatacagcatgagacacagcgttggggctttccaggtttcttacagaaatttccttacgacaaacttagggttagcatccacagaccatgctctcggtcacatccttcgacatctggattgcccaagacggttgcacaggatgcagactccaaagaggatgaggttggtacataacgttttgaattccaggataacctgaaacagaggcccctccactgcccacattaaaaggctgcacaaccaggagggcgccactttctgagtgtgggcttagagctgctgctctcgggctctagccccacttcttgtttgaacacatggctcaaggtttccctacgggtggaaaagatgaagaggacactggaggttaagaacccagcaggccgagcagtggcagcaatctccaccggaggcccggcctgtgcttcccctcctgggatggggtgaatgggggctggtcaggggtgccagatggtggtcttatttttacttgaattattctgcattttataactcaaggttcaaagctctgtgctaaaactagatcggacctttccaatttcttagaaaggttcctcgaattcagattcccaaaccaagtattcagctatttaaaacctatctgtgaatgtaagggcccaaacggaagctatttggggcgtgatttctaaaattaccatcacccccacctagaccagcctttgttgggggactagggataaagtgggttctctg

SEQ ID NO: 2513 - DNA, 510 bp, Homo sapiens
gcctttgtcacaaatctgaatctttattgttctgaaataaatgttataaacataactcaaaacaaaaacttcaatattcagtctaagaagaggtgtggctcaatgcccatcacatgtaacaagaaaaacctcctttaaaaaaaggaaaaaaaagtactatgagaagtctttcatatgaatgaaaatgcacccgttggatttttttccccctcatcacattagcttgtatacacgtgggaattgaaaggtttgcattttcttcacatagttcttgctatgatgtctgacggactttttgccactcaacaaattcatcaagaagaacaggccaagcaccatcttcatcatagttactaagatcagcatggactgttctgctgaattctaatacattgtaccattgatctttgttcataacacgatactttgattgctccaggtactggtaaaatactgaaaacagtggccatgtcctcccaagcagaagagctaacatagatttagcagtat

SEQ ID NO: 2514 - DNA, 517 bp, Homo sapiens
aacaattattttttcctcatttctctcagtaaccgcactaatgacttttaagtgccagcaagctgcaagtgctgccaatgagcccctgccctagaagggctacagttgggcaccatgtgctcaggggagggccccatggcagtcagtggagggtgggaagctggatggccctggccactcagcccagatagcaaggagggccttctcctcccaaggactcaaagtctcagaggccggagaaaggtgggggatggtctcccaggaagcagaatgctagaaggccttgcagggcaaacctgacgggccttcagggcacctgacagggctgggactgccggcttccctcacttctctcccgagcacaagaaaaccttccagcaggagccaggtgggcctgaggctgtgaggctgtcactcacttaccaggggattcaggcaccttgaacatggctttttcttgaagcagctgctcaggttggttcttgttgggtaggtccctcatcatctgcagctcctc

SEQ ID NO: 2515 - DNA, 834 bp, Homo sapiens
atcttcaaatttaaatttattaagacattcagctatgtctgtcagtctacatccaaatttgctactaaaaataaaataaagtcacatcccacattaggaataccgaggtctgaaaaacactttttgagccaagcctattgtataaataaatgactagtttcttttcatatcaaaattcccataaaaaattacattcccccctccccagttctacctgtagccatgatgaatgtaaaaatttaaatatgacacatccttgtcaaagaaaaggtgcaaagtctattaacagctttaaaagtggcatttgcagagtgtgatcatacagttatgtactcattcccaaagtgcaaatattgccataatttaacactgttttgattcagttgcaagaattaaacattacacaggattgaaaagtacacccagggcctctatcagtgccctaaagcccttcccactttggtctccttcactaaagcagactccaaagtgttcatcagagttttagtttacttcacacagccagcgaagtatacaacatatttaacaaaagtttcatatacatcaaaatattgaagactccgtcataaagttcaagagtctcagattacatgaatgcacccgcaaggcccaagtgcccacccaccccttccctaaagcacatacaaagtatgagcgtgcttcaatctttgaatacaatcaatgcttcttcatctttgatttcatttcagtgctgtacaagactcaataatcacctgactgagctccaattaactgaggagaaacggggtggaggagagggctggttgctattcagacttgataatgagattg

SEQ ID NO: 2516 - DNA, 437 bp, Homo sapiens
ctggtcccacagctgagtttattatacttgttttcttttacaaaattaaaaacatctaaaaccaggcccaagtggcagcttgagtccctccatttctggaaactgagaaggctccacctggcttgatatggacacagggtgtggggtggaggggaggaggtatggtgcccgaccaaggaggcaaggggcaagggtggcagactgaggagggagcaccgccacgagccacagtccctgagttataattcacagtaagaaggctcaggctgcagggggaggtcaaggctcagtgaggttctggggtgaccaggggtttccctggggaaggtggccggggccaagatgctctcgagccagtttagaggccagggcccttcctggccatctgtcccgtggcctagccgacactccgttcatctcacttggtgctctgggtt

SEQ ID NO: 2517 - DNA, 457 bp, Homo sapiens
taaggacagcaaaaatgtttatttgaaaaaattactatgtattgaaaatatacattagaaattattacatacttccatagcattcccctcccacaccacaaaagtagaaatatctgcttactatgctaatgccataggtaaattcaaacaaaaagtaaatcatcctcagtctcctttactcaaacactagagctgggggccagagaaaggtcaacttgtatctactaatcaataggaatttaacaagtcccagtcttccacagcaagacatacatatttctgctttgaaggttgtgaagagttattctgttctgtctctgactcctcaaaaggtctcttcttgctcttctttgactcctggcttgagatagcttcgtgtttcaacactggcccatggcaatctggggctttctctttatagaactggagtttctcggaagagttcatgtgggtgtct

SEQ ID NO: 2518 - DNA, 600 bp, Homo sapiens
tagttatcatacatttatttttaacatagcaccccagtttcacatcatgtatattttccaaagttggagatctttaactatgttcttcacagacctttcaacaagtgtgaaaaagaggcagtaaggttagcttgagtctacaagtcacaatccaaatataggacacctatgtttaaggtcaatatacataatgttcccaatgcttagcaaatgaatgagactctggctgagtaaaatattaacacaacttgttagcacattatcatgaaaagacagaaggcatcaaatatatactttgctgttacactttttactgttcaatgtacttgtagtgaaaaaatatacatttttactttcaaggttaaaatagaccatcagctcattatctctcttagccaatagctatgaagactaaaatggctcttcttgcttctggctcacttgaacatcttatttgtgctgaagacaaaaaggatagcagtgctaaagaaaagggtatacccggttcccaagataggtgcggttgaggttctcgcacaaggtgacttaaaacaaaaataacacaactcagttgatccaatctccacacaatggggttgc

SEQ ID NO: 2519 - DNA, 708 bp, Homo sapiens
actgctttcttgattttatttcaaaagtacacaaggtcacaaaactagagcaagttgtttttcttaacaaattttgttcttacaaatttcaaaatctgcaccattggatatataagccagaaatcgtacatacaaaatctgaaactgacactgtcagttctatactttgcacacgtgaagtgtcagaatattttcttcagtagtacaggtgtatttatcactaaaattcacaattagggaaaagaataagtgaatcaatgaattgtggttctcttaaaacttgtgtcattaaataagttagcagaaaacacaaagttctgttttgatggagcttttagtctcgatgaccaaaaccaaacccaactgatatgtactatattcttaaattataaaataagataaattataaaagttaaccataatgaataagaggctggggttatctgctataagataaatgatcagccttccctaaagataaataaactgaaccacaattcacaaatgtgtttattattcttccctgcttctataacatttataaaaggaatttgtgctcagttgtggtctattttagtgttaaaataggtaaatgagtaagaaatcctattgcagaacatgatgcctttattgctggaatatccaaaggcattcaaaatattaaaacttgcccagaacatttacactactaaacacaggaatgttata

SEQ ID NO: 2520 - DNA, 911 bp, Homo sapiens
gaataatataacagttttattataaatcaaaacaccaaacttttgcaaactttacataaacgtgtagccatatgactgtataacaagagcccaagagcaaccattgtctaacaggtagaaatgcagacagtttcatgttaagcctttagaatttcctttcacggcaggtttccaaaataaactaacttttctaacatttattctcacaaaaatatatttcaagttagaataaacaactcattggcttcagacatttaattgtatgtatttaaccatactcagataattgtcatatttagccaaatggaggctttttctgtgacctatttccaaattctcagattctggttcatctactccttcaagcagtttggaatgacttgccagttggcatttatatcattggaactattctgcaaataagccattttgataaagcttgcttggtttgagacaactatgtatttggagataaaagactcagaacaaagtgcttgccttttctacagtttatatcaaacgagatgggcacttaagcagtcagcctggattcatatgtctagagtggccaggctgtaaatacaataagtctagctgccttccacatgtggtcagacagctatattaagaagatctactcactgctggttatgaagatagccaggagcttgtctgatttaaggaactattcagccattgaaggatagacactcccaaaaatggaatttcagggaagtgtagaatgaacaatcctgttcaaagcagccaaaattattttctgcatgccaagatgttattcacacacataaatactatatgcagataatcttcatttttgaattacaagttgttttattgcaaaagcaagtatagttataatatatagcaaagcgaatctatctttggttcta

SEQ ID NO: 2521 - DNA, 519 bp, Homo sapiens
tgatataaaataacttttatttacataatttatatatatatataactgctttctttagaacaagaaaatttataaatgacatgatattgctttttctgtcaaagacttcttcaagcaagatagtatacatggtcacttttgtttcaaataacatgatggtaaacagtggatattaatatttttgtcatgcctcaaccatttaccaacaattaggcgttcaaatcctcatgttgaccacttgctaagacataagtgttcaggagaaaaagtcaagaaaagataaaaacttttactcatatctcctttaaaatttgtgaaataaatcctttgcaacatcttcttcacatgaatcagacctaacatagttctttccaacatgtaaggtaaatacattgattaactttctcttttccaaaattaggtttaaggatttaacagtaggatactttagctggctgacttgattctctaatacaatgagtctctgtattctttatatagtaagaaattccattttcc

SEQ ID NO: 2522 - DNA, 478 bp, Homo sapiens
ttgtaaaatagtcttcccttttattttaaatcaacccttttccaagttagtgccacgagttgagatcagggggtcagagcccactgggatgtggcaggggcagcagggggactcatgtcccccacccccagcttagtccctccaaggatgggaccggcagccagggatgaagggtgcgaggcgaggctgtctgccccctcccctgccagccctactccctagtctgccccctcagctactcccaaggccaaggacagaaatgggagcacagtggccaagagcagggaggcggtcctgtgcaggctgtccatggccaagagtgttagtggtcagagcccaggcaggctgggttagtggggtctcctccggcagccagggaaggaacgaagaggggagccaggctccagtccagccgggaggaggggctcagatagacgactgccactgcacaaagcgcttggattcctgagggttgaaa

SEQ ID NO: 2523 - DNA, 1096 bp, Homo sapiens
cccggccgccacccccaccgccgccgccccccgaggagagctgcccggccaagcccgtggcccccgggccctgcttcgggggccgcaccttggaggagatctggagggcggccaccccgacgctgaccaccttccccaccatccgcgtcggcagcgacgtgtggggcgagcgcagcctggcggcagcgcggcgcagggcgcgccaggtcctgcgagtgaacctggaacccatggtgaggctccgccgcttcccggtgccccgggcatgaggtgcggcctccagggcgcctcctgccggccccgaccttgggacaggccttccgcccggaggaatgaacaagtgtcagtcgagtgtttacagatccggccaggaccccggcccccaatgcactttacgcgcgaagaagttgccggatggttgtccctgtcccgggccgcggcgcggtcgtcttggacgctggggcaggtgtgccctctgctgcctcccgtacccggcctgcggagggaggggacagctggacccgcaggggaggtccctttcttcctgaccaccgattgagacgtctccaggaccttaggggcagatccgttttctcactgttggactctacctcactggtctgtaagtcctccgaagacattatttttccaaaggaatttggtttcgtgcttgtgtaataaagccagaatttacttgttctttacccccccctttttctatttcactgtcacccctctttgtggacagaagttcgaacatgtggtgttgcactagtttgtgctcagggtattctgaagcccactcgtttcctaatttttactggattccaaagctttgatcgaggatattttttaagaggttcaagcttgtgactgttagtagtgcaaggatttgtatgggctcagtgattacaaacaaagacatgcaaaatacaactgtttaaacattttcaaggtatttttaaaggttttgtattgaaacaatgtttatatttactgagctcctaaaaatggtagaatacacatgaaaacttttgtttaggaaaagttaacttgttaaattcttttgaattgaataaaaaaatgcattgaaacc

SEQ ID NO: 2524 - DNA, 917 bp, Homo sapiens
gatctttttgctgattttattatactatatagatttgtatttcttgtgatctgagaaacatcaaaattctattttaaatttgttcttaaaaatatacaatattgcactttaatttttggcagcttaacaggaatgaatgagtacaaaaaatcatacaagaaactagaatttttattttgcttcataataagagctttgtgaaaaacaaaacttacagtagtgccaaataaaccaaatatttacagtatagatattaaagtcttacctctaaaggaagattcagtgtattggatgtaaatattattaatataagaaaagtcacccccactgcccaattctgctgaacattttaagccaaagagtattggtgagaaatgcttctgtgatttctttctcaagacatacatggaagggatgcttgttcttggagcatctaaagtgggtcattaaacttttacaaaaatgtttcctccataacttaaaaaaaacctctactctaagccaagaatccaaggtaagcttattttttattttttaaagttcttctgtagttactctctcttttttttaaaataaatagaaatgaggtgtcactacattgcctaggctggtcttgaactcataggctcaagtgatcctcctgccttggcctcccaaagtgctggaattttataggcatgagccaccgtgcccggccagttattctcctttacttttataagcatgtaagttagttggtaggttacaattttaaggtctgtttcctgtgctttttctaagatatattgaattggatactgaatacacatctgcctgattttcaacttttgttacattgtaataaaactgtatacatttactttgacccacaatttgtttttactttttttttctcttaactagggtctcgctgtggc

SEQ ID NO: 2525 - DNA, 991 bp, Homo sapiens
aaaatattaccttttattttctcaggcacacaagtgatttggataccaattatcaagacattttactgatttccctttagaatgatctattttaaatcttcagccaccttagaaaaagtttgcagcaatcactttgcaattcataagtatcaggttagaatttagttgtggaataagttaacagtttatgttcaatatgtgaggttatttgaactcctgagttttaaatatcctgtggaacagtgattcctctcccttctaatggcttttcagattaaagcaatgactttaaaaagattacatcctaaatacttgattacaacagaaatcgaccaatctaaaaatcagatagtgttatactgaacatcattctgatataatgagtagcctctggctgaaacaaaattccaccaccaaggccatcaaccaggttagtactgtttttcctggggtctatgtaaaactctccttttctctgcaaatgctgcttggctgtgaacagcatggatttacctgcaccaatgtggcacacacctagcaactttctcaagcattctaaagatatccccagagctaacaaatattgacatatgtcacagcacctttctcaagaacagtccaaatcagcagtgcacattcacacacacaggaatgctggggatatgcttatacctgcaccacttagttacaacaaggggaaataagagtaactaatgaacttaatagcttcacaagaaaaatgttttatagtcatatacttgaccctatcagggaaaagccacctaaaagcatgtgtagctggttacaaagtgcatcaagggagagaatggctggctctgaataaacccacagtcacttctgaacataaagtacacattctaatgacagagatttggtaatattattttcacaaaccaaacagtacaaatttcaagttatttcacaaatcagatgatcaaataaaaatggacatgaatatgcttagtaaatt

SEQ ID NO: 2526 - DNA, 954 bp, Homo sapiens
ttgtattctctaaaatttatttacagttaataagttaaaaagcaaagtacaagcagattataaatctcaaccataagcacatcaaactgtccagggaaacactttgattccattacaaacaattgttttctaatgcgcttaagacataacactctatcaaaaaatattttaaacacaccaataaatattaggcatgtatgtccattaaaaaccattaaagagtcctgtggcaatccttaaaacaatgaaaaacttttgagttcaaaattgctcagatattttgtattcaaatatttttaaaatttacttaagagttttctaaaaaatagtactatcatttgcacacagcagatcaataggtgtcagtcaccagcttaagttacacttgtcaatattcaaacttgaataaaataaacacacatcacaacagcgacactttgcactatcaacaatgaagcttgccctcaacaattatgacgttactggttttagtaacataaaaatacattgctggttgacaggaaggataaaaatgacatcaagaatctcaaaaagttatgtgaggtgccggtcaccacatttaggcactcaggaattaaaaatcaaataaaagcatagcaaggtgatgaatttcctcctggcttccccctctacttgtgccatatgagataaaagagaaggcaagagaatgaacgaagatcatgagatttctttcaaaaactatacacaagctaagctacagacttcacttcagaggagtaagtggatgcctcattataaaggccactatgccaagtttcttttcacattctgtgacaaagtacccatgaaatactttcactttcctattagtataccagtcaactatattagatgttgcttcacattttaaaagttgtcacataggtttttaccaaagggcaaaaataaagattttttacatcattatttcac

SEQ ID NO: 2527 - DNA, 908 bp, Homo sapiens
  Modified_base 583: n = a,c,g, or t
ttgattgtaaaaattttattctcaataacaattccactaaaattatacaaagtacattcaatacttaagaatggcaaaggtggggagaggaggagaggaagccagtttggcctggaagcatcaacagttgactccaacaaaggaagcccagctgggctggaggaagttgggggtggaggtccggttgtaaaaaataaaaaaggggatcggtaaaaaaaggccacccacaaggaagcagagtgagcgtgcatgttcctgggggagggcaggaggctcagctgacatgctgctgctgggcactggagctcaggcgggctccgagttggtggggggcaggtttttatgcttgaaatactgcacaacttgttggggcagctccgccagcacagctttggccaaggtctcttttgctgcgttgcggaactctcgaaagggaacgaactgcacaatatcgcgggctgcctcctcccccgtgtgggagcgcagcatgcggctgtccccatccaggaactccatggcagcgaagtccgcattgcccacgcccacgatgatgatggacatgggcagcttggaagcctgcaanccggcatgccgtgtctcctccatgtcactgatgaccccgtccgtgatgatgaggaggatgaaagtactgcgtggccgtccgctgttgtgtggcctgggccgcaaaccgggccacgtggttgacgatgggggagaaattggtaggaccgtagaagcggatgtggggcaggcaagctgagtacgcctgggcaataccatccacacctgagcagaaggggttggtggggttgaagttgatggcaaactcatgggagaccttccagtctgggggtaactgggccccgaatcccagagctggaaacatcttatcactgtcgtagtcctga

SEQ ID NO: 2528 - DNA, 718 bp, Homo sapiens
aagggtacaaagaagtttattgactatgatgcagtaaagataccaagagttacaatatttgtgcatatggcccaacagtgcctaccctcctacaaaacaaaaacaaaaacaaaaaaaggcaatgaggtgcagcagttaacagcccaacactggagtcaaaggaatggagctgcctcttctggcagcaaagtttcaagttgtgcaattaaataatagtcttggtccactccttgtgggtcttcttacagtttccctttagaaccataactgagtgacttagtagaacattcatattcaggatgtggcctccagaagtgtcgttttgttttgttttgaacaaagacgtgctaccttctctcttgaagcaccagtgctgggttcaggagctacagaggactaagatgttccccaagtagcctgaagtaacaggtcacatggaaaacacaaagcaattggtgagtccacattttgtaatagaattaagagcgtaatgcataaaacttaaagtcatgtaaccacatgtaaaaacttcagcagctaaagaaaaattctggaaggcttttaaccccttctgaactaagttccctttctaaacgaggctggtttccatggctgtgacaagagctcatggggtagcaaaaagagagagagaatagcaccttagaagttactcaaacaagaggtgaaacaaataagtaaaaaaaaaaagaccacttta

SEQ ID NO: 2529 - DNA, 973 bp, Homo sapiens
ccttcgtatgccacctttattgtgtttccccaactcctgggccccatggtagactggccacatggctactgggctcctggccttcctagggctagcagctggtgggcaaacactctgccctgctggagagctgccaggccatgcccgggcacaggctagtggggctcctggctcagtcctgatagcagtgccagggaggcgtagagtgcacacatgcggccctgggcctgcggctcccagcacacgtggggagtgtcctcccccagctctaggccacactcgtccagcaagacccaggccggtgctccttcgccccagctgttccccaggagcccggggggcagggacatggtgctgcgctcctgccacggggcactctgctccaagaggctgcccaccagctcgagcggccccaacagggtctgcgactccagcgcctccgccagcagcttgtgctgcgtttcactcagcatggtcagtgcccccagcaggtagacaacagggatagcgagttccggcaccagaattccggaggacaacaccaggcactccaggacagcacctgctggaccgtccaggggctccaccggcccaaggctctggcctgtccagcgcctcctccaaggctcgcagggccagctggtcccggagcacccctttcaggcccttccacagcagctggcacagctctctgtccaaaagctccagttccttggagatggtctccacctctgcccgtaggccctggaagtcttcagtgaacgccccctccgcagggaccccatctgtcaggaagttgtggaggcacctcatcatggagaggccagagggcagctgtggccaggcgccttcgctcgtggaacgcttgtggcctgtcgcgggtggctggaaggtcctctgcttcttatccgggaagagaaggacgtccaagtcagagtcaataaccagctgggccacccggaatgcgagggtg

SEQ ID NO: 2530 - DNA, 649 bp, Homo sapiens
ggctggtacacactgctttatttgttctttttattattatttttaagttcacctacagctgcagtacacacacaccgctttatttggctagctgctattcagaagacacttcctgaattcaggaaaaatttttttaaaaacctgagaacaattcctgtgacttcttagctttgatgaagtgcatttactttgacattgatatagcttgtaactacttttggaatttttttcccctaacactttgatctcattaagggtattacaccttttccaccagaaaatgcagaggtatcatctttcttggaaaccaattgaaagcgtcccattttaacaaaatgacataaaattacaaacatttacatgattaaattcaaagcctgatccatctggtggtaagaaatgttaacttattttaaaagatgtatttgcattattaaaatatagtaacgacttccatctttacatcaaaagaaacgggcttgcataagcaatggctcccagctctggggagggtttgagccacgcccttgcgggggccgctccaagctctgacttcaaaagttggagtttcccagctgcgaacagctggtcaaaggcactctcaaaagttcaaggaaatgcccgtttgcggatggccgcagcaggcctg

SEQ ID NO: 2531 - DNA, 614 bp, Homo sapiens
tttgttacagaggatctttatttataatgcaaaaaagaaattataaatcccattttggactgtttccgtatctgtaaaacaacttataaaaaacagccactccacctgcaagaagttcttgttggtgcttatggcaggggcatgtgtttgcacagccctgggggctgggagggtgtgtttgtccagaagagagcctctccctgggaccccaacagccaggaccatggcgctccctttcaccaggccggagtcagcaagaacctggaggtgtcagaggtccggtccactcagcggggcctgggaaacactgttctggaagtggacaggctggattcctcgctggtcctgccacgtctctctgagcggaggcccgggttcgctcagttcccatccagggtattcagcacacctgctccaggcagccacgcccccggacacctgaagccgggccgctggagcaggagccagccagccaaacccaggacacctcctcaggcttctgggtcgatttctccatcatctgggcacgaccctgtctcatccagccagactgtgctccccaagtccctcggcagcatcatgcccgtgggggtggggggcgtgatgatgatgtc

SEQ ID NO: 2532 - DNA, 438 bp, Homo sapiens
gcattctgaagtcgtttttattcgataactaacaccataataaccagagttccatctgagaggagaggagagtgagaaggggccagaaccctttggtggctgagaagcctcctcaaggctatgttggggcagtagggaggcagagaggtgaagatcttagggaagcccctgacccagcctaggctgctgcccacagggcaggaggaaagcccaggaggggagacaagacctccctgttgcaaccaggaggctgagcaaggcactggtgtttacagcccacagcttcacccgggaggggcgagggctcctgccctgcgagagcctttaggtgtacagttggggaaagggcagttcagctgttggctggagccagttctccgggctccaggtggtgccagaggcctccatgaggtggaaagtgtaggcctggcgcgagcg

SEQ ID NO: 2533 - DNA, 519 bp, Homo sapiens
gaatggaacgcatatctgcatagttttatttctttctcaattccaccagaaaaagggattttcagaaaaaggcacagttgtgcttcctctaaagatgtagtctgcggtttgggaagtgctggttccctgaggttatctggagcgctggttgtaaagaagaaagttcttgtcttggcagagcaggcagagtttcaggcttcggcagctgcctcccgcagctaagaatgcccaggtgcccatgagcaccaggattatcaatgctgacgccaggtttattccataataagaacttatgaaggtctgggctgacaccagcaggtgggtcaggagaacgataaggaggatgccccactttttcttctcacagccatcaaaaaatacaatgccccagaatacatgcagcaagataatgaccagcgtcatgaaagctgaataaaggaagaattgaggagaatctccatgaatgcccactgtgcctggccccaaggagtcagatagggtattcacaaaggaaaatac

SEQ ID NO: 2534 - DNA, 949 bp, Homo sapiens
ccatacaaagaattttttattgacattgtaagaaacatttttttttctttgttacaaaaggactaagtggttctgaaagcaaaggtagagttcatctgtggctgggctgcagcccctgggcttgaggtgggcgtgatcacggggaatgcaggcttgtccgaggaacgcctgggccagtcacatctgaacgctatgcctacaatacttaaatgtatttacatgtgtttcttttaaaaaaaggattacacattttattttttaaaaaaatctaaaaaaggtgaaaaaaatgaacttgtattttattttacatgtctgcaggatacacaagggtaacttgtcagaagagaacatcctcctatcagttcaaaacaacacatgaaaccaggatacaagacagcctcgactctgctaccaccgtgcgctctctggctggtgcacacacagccttggagtgctgattgggcaacaccaactggtccctctcattgacaagattaacataaaataaggcacatacatcgcaagaatcaaaactttgtggctcaagaggaagagccaatgtgtgaggagttgggaggggttaactttttcagaaaaataaaacaaaaatggttagaaaacgtttaacacagacattaagcaggagtagaatgtgtgagcctgcatgttttagaaaaggcaggatggtgacactagtgaggcggtcctctcgctctaaaatgcataggttagagaaatggagagaggcttggaggctgggggtgagtctcaagatatgagatgcctagcctacaaaagatcccaaaaggatgtcccaaaaagatgcttctaagtgacctcaaaagaccttccttccactggactgccacaacagatcactgaaattctggaggagtatactttcttcttcctccctcctcacctctgtccttctgaaatttccatattg

SEQ ID NO: 2535 - DNA, 1012 bp, Homo sapiens
tagcagtccataatgagcaacttttattggcattagggtgtcagtcctgtaaggatcatcacttaagtgtgtctcagtggagaaaagatcaagaatcatgtcaagaagaccatggggttttattccacttgagcaagagcaaatcagagccccatcaagcaggaatggtggcctttcccaggttccatccttaactaaactgactgttcccccttctgatttctccacggtcttctgtctcttgctctgccaaacttgttttcttatctctgtagagatgagtggcttgtttgatgttctttccatggcaaaaatttattcaatgcaaagttcacttcagacacttggttgagacttgaagtttagaccaatcctgagatgcgtggtgatcctgagagagagcagactgcctgccaggtaaatggtccatattatttccttggcagaggccctgacaggggctggggtccgtgttacctcagcagtctttctgcttggcctactcttgctgctctgtaggaaggccctatctggccatttctgtgaaacttgccccttctcaagcactccgtaactgttggtgttggcccatcaggcaataaggggatgcccgaggtctgtgcttccaaggataatagaaacacccatgtgtgtggtaagataaaggtaaggacactaaagaacagagtgtgagaggtgagttctaaataacaacagatgaagaaaggattggatccaccagcttctctgccagttgtgattttgatacaagttgtgttgctttgagctcctagcagagagctaacactacctgctgtgtattttggtcctctgtcctatactcctccaagacatttgcaaagcaccacttagatgggggactgggccatagtccatccctaagaaactgagagctcctgaatcccggatctctgtggcaagattcagggatgactgggtttccttacagaagaggagctcagctgagcaaagcctggaggacatattccat

SEQ ID NO: 2536 - DNA, 845 bp, Homo sapiens
caaacataccaggatttttttatttttcagtgtaaaaatcaaacatgataaacctagaaaactatcagcagggctatttcttacagggttccagcaagggttagcattgttacatttcagaagctgactttctttaaaccatctttacagaggagtaaacttcacagttccacacatggctgggctccaggtagaactccataggagtgacgagggaaagtcaccactgggcagggagggcatttctgagaaatgcagatgagaggagaggctgtgagcacaggctgtgtcaaaacccagggcaagggctccctcccgccttccctcccagtgggaaggccaccctgagccccaaaccacattctgttccttcctcgtcattctgcagacaatggtcatccacagaccacacgtgtggtggctttggcaaccagaaatttaaaataagctatggtttttccagtagccaaaatgatcctgcaccaaagctcatagactgagaacctgagcatgcaaaaccacagtctgggtgaagggatgtctgctttgtaaatgacctgctaattctttgcaacccacagtaatttggtttctgtgaacccacagaagcaggcccaccaaaaagggccttgtctgctagcctggagtatacatgagtcactggcggtgggatcagtcattttttaggctgccccattttcctaacatgttaaaatgtgtgttctcagtcttttcaagagaggaagaagcaaagcggcacttacagagtgtgagatagacacagatctgtggcgagggattggggaaggtgggtggcatcttgggactctctccaggctttctgg

SEQ ID NO: 2537 - DNA, 1282 bp, Homo sapiens
caacatctaaatagacttttatttttattttacttgtttggacagaaaagaaaattcatcagctttcattagagtctccttaagtgttggaaacacattaaactcagaaatagtggaccttgtagaaaagcatcacaaattaaaaatatatttctccatgtggtaaaagtgctttcaatcccattaaagggcacagcaagggtgtttggaaacacgatctgaaatttggcctgcaatccgtggcatcgattccaaccacagggcgggggagtcaccatgatctagagcacaggagccacgtggggcccggagcatgcggacagcaacactcgcaataactgagtgaggacgaggcccatagcctgagtagaatagattctgtatttgtaaaaaatgaggtggttacatcaactgggttgaagggggactgggtaatcccagaaattccttgtttctggtctgtggggatggtcagatctgcccaccactctggcaccgaggcttccctggagacgcataaacctgggttgggaaagtgcccagatctgcctgggggacacacgagcctcgctgccagtgccgggcacgcagcctctccagtcctgccgtcagcaaccgcctccggccctcatgtcaaatcacacctgaccagagttgtcaccacagtcctgttttggggtttttccaaggccagccctgttgttctgaggggccactctgagcaggcaaacactgccagggtcactcactacacacagaggaaagacaatgagcaaatggccatcgtagagaattcggttgtgtgtttcagcaatgctacttatttttcaagacaagtaattctgccaatgatgacatctgcgacaaagcttagggcccgcgggctccccatgcgcctcgtggagagcaaccacgtctgttcggaagccagcggcccttcccggccctgccacaggccagaacacagaactgtgatcatgcaaagagccgtgactgaggccggggtcagcgtcgggggtggagaggaggggacatctgccttttacattagatctgaagcaacagtaagaaaataacctgaagatatatttaaaaataaaaaatagcatcatccttcactccaagtttttggcatttccctctctcccctgcccaccagctaagcagagggaatgagcaggaatgcctcgtttttcagaatgggcacccactccccatttcaccactgtacacccaggatgtgtgtcttcttctaagagaccggttcaaaggtgctggcatg

SEQ ID NO: 2538 - DNA, 928 bp, Homo sapiens
gtggaaatactttgcagagtttatttggacaggttcaaaaatagtccttcgacaatacaatcagatcgaaccacgacaagtaaaatgcaattatgggttggttacatttttaaaaaatgtaaacaggtttgggaaaactaaaagcaaaactacatcgtcatctcctccattcccaacccctgcatttcttacaagcaggacttcaagacggcatctgcaatcttttgaaatggatgagaggatgacactcactaaaggagacagctcaacagtgtgttctgaggccatttctcagaacaaaggcatacttctgcataaggcaaatgcagcctgataaagcttcccctagtgggtacatggaatgccaaagtcattcacctaaatgagctcaaaatacatattgttctgggccaaattatacagtgtcaagctcagactgtatgtatttatgtatgttggcagagcaggccacttttggggcgccacagctttatcctagcatcctgtgccctgctgggttcccatcgctgtctccccaaacccatgaatttccttggatttggttccagaaaggcagacaagaaacaaagtcagttgcacaagcccacaagggaacagggccccagaggacttgaatttctaatgaaacttaagagtaacacagaatgtgtgcctttgccaacaagccgggactttctgaaggttgatctgagatgggggcagggagtggggacaagatcaagtgtgctttgggccagcctccgctaagggcaacaaggcgggaatacaaagctatctagaactaaagcaactggccagtgcttcctgtggcctctatccagaactattccctcagacagctgacccctttctcagagcacttcagtggtgcttccaaggtgccaaagggatccatccaaataaatgc

SEQ ID NO: 2539 - DNA, 819 bp, Homo sapiens
acaatttcaacatgttttttatttgctcacttaacattccaaacaaaatgacattttacactattgcttttacttaagaagtcaactgccttatccaaagtagacaaaaatcccaattcctttaagtgtccaagtggtactttttcccccagagaaagctacttgaatactttaacagaaacatagaatcgtcctataatagtaaggtagtagttgggtctaacctgtactacatttaaaacttttctcattaaaaaatgaatacagaaaaaaaccccaaacacctccagtcatcattcctctcagatttttaacaattccactaaccttcattaaaaattgcttttgtagagaggtgtataaatatgaaaatggaaagtaagcctccccacacctgttcatagagaagtggggtagagcatttatcctgagaaaactgctgctggtccctgttatttcaaaaaggataataaacattatggcccaccaagtcaaacctcctatcttctgtgccatgatcatgtgtaaccttttctgttctggctacgagcatctacttttcacactcatgcgattcttctcctttgagcaaatctttgatgaagttgtatttcactgaatgttctcaaaggggagaaagagtgcatgagcaattatagtactggaacaaaagtgaagagtacatatattttcacgtagaaaaaatacatacaaatccaagtagctcctaaaaatagaaatcagatgggcatttttaagaaaaagattgttttctaaactgtaaatggtgccagtaagacactgatttttatatctagc

SEQ ID NO: 2540 - DNA, 1343 bp, Homo sapiens
gatgtaaagcttataatagcaggtcaataaatatctggtgaatgagtgagtcaatgagtgaattatgtgagtagggtaggaagacaaatgagagaagcagagtcaggtttcaagcagattggggtcagacaagcaaccttgtatttctcagtcttggcttaccagtgctgctgactttgccgtgagcattttactcctcattctcccatcctggtcccctcagtatcctccctaaaaggtggaacagcactgagctgacctttccccccaaaccccaggcctcacttctgcctccgaagccctctgctgccccagtaagggacagtagggctgcacgctgcctctcagctgcctgcacaggtgtggccagagagcaggactggagggttccttctggtaccttcttgaagggctcccaatgccaagctcctttccttcccaccttcacatcactgaggatgagaagaggtgtggaatgagtggggatcagctggggcagcggggccccgagtggctgtgtcctgggtgacaccagagcactggaaccatggcactgtccaaggaaacccgaaagaggccctgcagccttgtccctactccaaggtcttctcagagtggcctggggtcctcgtcagagccaggtcagtgagcctgaacttggcttggagactttctgaaaggatggagagtgctggttcctccaagtgaggggaacacaggctggaagcctccctgccctggccctgccccctctagtttttggtttgatatcagcccttctgcacagggagcggggaaggagggaagaagagagggaggggacccaaggctcaggattccccgacccagagcccctttaaggcagataatttgtgctttacaaagacattgatgaaaacacaaacaaaccctcaatgaccaaacaaatgagagagagagagatcacagtgtgtcaagaagggcagcaagatcgggagggaggtatggggtgggaaggctggggagtccaggcggggtcctcagggcaggctagcaatgtctctctctggaggggggccaactggcttggggctgctctcgttggcttttccttcaaacatcatgactaacttgaggacagccgaccgtttccccagcatcatgttcacaaagtctcggtaggatatagtgtcactgacccctcctgtcacctctgagatcatcttcttcatctccaggtgggtcttggggacaccaagcttctccatcatcctctttaaagacatcaggtcaatctcgccttcattgttcaggtcaaactccatgtacttctctttgaaggctgtgagcttttctggaaggtt

SEQ ID NO: 2541 - DNA, 702 bp, Homo sapiens
aacagtggagtaattttattcacatagggttgcgattaaaaggttaactcattcaaacacatttttgctatgctaacattcctttgcctcttattcttacaaataaacccccatcacagagcagaaatgttagaaattatatcacaaatggagcacaataagtatttttaaaaccttttaaaatatggcttataattttacacagcaagttacctattaatatgttacatattaacagatctatttggacaatcagatttccttgagattaaggatggagttggcatttttcctttaagaaggcattttaaggccgggcatggtggctcatgcctgtaatcccaatactgggaggccgaggcaggcagatcacaaggtcaggagttcgagaccagcctgaccaacatggtgaatccccatatctactaaaaatacaaaaaattagccaggcatagtggtgcctgcctgtaatcccagctacttgggaggctgaggcaggagaatcgcttgaacctgggagatggaggttgcagagccgagatcatgccactgcagtccagcctgggtgacaaagcaagactccgttctcaaaaaaaaaaaaaaaaaaaaagaaggtattttaagcctgttaggggaggttctatagtatggagcttctttataaagtggtatcttatgtatatcaaaaacaaaagcgagatc

SEQ ID NO: 2542 - DNA, 1616 bp, Homo sapiens
gttcaaaaattttttattaataattcattttcatagctcagaaaaggatataatcagtagaacaactaaaaacaaaacctcacctctacagagatagccagtgtgtagactttattacataggcacatattaaaaaaaaaaaaacataaactggttttacataaaattaaccacaatagtgcaagaggttacactgaatgagaatggatgatgaatgatggaaaatgtaaggcttggaacagctgaatcattcactggatcttgggttcatccatcctgacgcactgaaatttattacagacattacaagaatggagggtgaggaatggtgcttctctgtcatcgcctggctaaaacactgattttgattaatctcttgaatacggtagttttctccaggttctcttgttaagtagacataaaagttaaatgaatgctggcttaaggtcagaggagttcatatccttctcttccctcacccctatactttagaactctcacacccaacaatttgctgttgggacctgactatacatctgctttcccacaatgctctggtagaataccactggggttgctgatccaaagcacatggaggcgcaacagtgcttaaggcttcagtcatggtgtggggctagacagcatccccaactagaattgagggtttgatctgtggggtaacacgagcaagcaggaagaggatgctggaattccttactctgtccagttggaatcaatccaacacatctgactaccacaaatacaaccagaaaagaaactaaaattacacactcaaacataccatgaaagagatgctattttgtagcttgtacatagtttaaaatttttttaactacaatttgatgttactaagagacaacgaggatacagaggggactgtcccttttctctcatctggttttgccataacttacaaatagtcccaggatgtttactgagtgtcctccttcaattttcacaatattttatacaaaatgacaaatatatatatacctcattgattatcctatcatccccagtacttggagggttagacctacttctgtgtcaggtagcacccaaatcctaacatctattttggagacctgtctgtgcctcttcatgctcacaccattgttctgatagatgatgccagtggaacttccaaagaagcattccacctgatcttcaccaccctggttgatcctctttttaaaggtgtgtgtggaaggcaactgcaatatagaggatttggaaggttgtctgtttctgttgtctggggaaatgataaaaaaaaaaaaaaaaagagagagagatgtgaaaaggaaaaagatggaccaggtgatttttccaatcttcaaaatttaaatttcttggttcttataaacataggaagagtcactgaaaggtggcaccaatggatattttgtaaaataacccacaactttagagctggaaaggacttgaagaaacaattaatccaacttcctcacttttttgtctcaggaaactgaagcccaattgggaaaacagcaacttacttaacatagtgattgtctccatggctatgtcctgtaaagattcacagaaaccccaatttccccttaatcctcgtg

SEQ ID NO: 2543 - DNA, 1118 bp, Homo sapiens
ataaacataactgcatctttaattgggtgtacttgaataattgaaaactgaacagcaaatcaatttttatggttcattttctccaacaaacaacaatattaaactgtatgagaagtaatatttattgcaacaggttatgaggtggaaacaaataattagtcttacaatttgctagaagcatgacagagcttactaacattttgaagaaaaaacagcaaagaaagaaatcatcaaacaagatggtatcttgacaaaggcacagcgctccacaactgcttcatactctgtgcacaagaaatcctctcaagagagaggagaggagtgatgccaaatgggcttacattagacccgtggacactaccactggtattattcatacaaccaaggctctacaacacccctctggagaaaaagtgcaacacaaaatctgtgtaacaaaggaaagcaaaagtagcaataagggcccagaggaatacaaacagtgcaaatacagtactgcaaactcagtaaaaggagtttttgattggagtatgaactttcaagttgaagatatatttcacaggaatattcacccaaagcttgagagctagagcgaggagagacttgcagtcggtaactgagtagatgaaatgcataatttttcactaggtgataatttcctttgggaagaagtgctttatctttaattattccactttttgttaaatggttcatgcttttaaactgcgattgtctcaaacttgcttgctattgaattgtgtaacatcagataatggcaagttgtcaaaagataaccccagtggatatttgaagctgcttttacgagaagcatggtgctgagctgccttacacagtctttttacagtaaccataaaaaactgagtttatttgatcatgtattatcccttctcacataaagtcatattagaggaattctttttaaaagcttctttcaaactagtcctttgggcatttaaaaaatcattatataaaagtacacttcttcaatacataagaacaaatattttttctttaccaaaaaaacctcatttttaggccaaaataagttacaacttgctgaaaaccttttatggctcagtgctcattctagatatatg

SEQ ID NO: 2544 - DNA, 517 bp, Homo sapiens
gagtgccagacaatctttttattgttcactgaaaaatgcaggtctgcaaagagtcaattgcattgtatattgaatgcaaggtctgatattgcaagtatatatgacatggtataacatataaaatattacatattttacacagtgacagtacccgcctcttctaaacactaaaatttaatagaatgaagtaaaaagcctattaaataagaaacaaacactgcaatcataaacaaaatgcactaagcaaaatactttaaaattgttgtgtgtgacatctatcttgtctacctggagttaggaatggtggagcccagaaaaaaactgagctaacaaaaacagccaacaccctccaggaactcttccctggaatcaggccgctggtgcccgtcacaggctgcccccatctgatgacccagccaggcttcagggctgcctgagggcccacactgaatgctaacgcctgtctggggctgggctgaggtgaatgggaggagtaccaggtaggaagaagcttctc

SEQ ID NO: 2545 - DNA, 893 bp, Homo sapiens
gagttttagcaggaggggatatgcatgtacacatatgcatatacatacaggtttatttaagtgattggatctacacttttggaggctatttgaagtatcttatcaaaataaaacgcattttaagcaagaggttaaaaaagcttttcagacccgaaggccatttaatacagtaaatcttacttgggtagtttagcaaacattttttaaaatccacatccaacagattggttagtattagatacacagatttggtttcaaagctgaaatacccctggtggaataaatcttctcatgaaattcagttatattatgccacaaaacagggacacttatctattgacaacttaaatattaactcagtaggctacctggtgatataaataggaaaaaaacagtggtcatggattaggagtgagaagactatgacaccagcctaccttggactgggaccgcaaaggatgttaaaatctatcctagaatttaaaacaggaaaaatgtcaaatattccactccccattcggcccaaaccatcccccaaggaatacacccccaccccacccccacatgaggtttactaaccagctgctacagatgttactatgtcactaattaacaatgatcacagaaaatgtgtcataccagagtttttgttatcatacacaatgcattagtggctgcaggaatcttcctccaaaagctaccgtcagaaggcaaactgacaaatgtccatgccgctggtccaagaaaccacagctaagagccatgaggcattcatttgtacattgagctctctctggcatgctccccactctagttagaggggctggggtatggagagaccgtcccagccgggcgctgcagcctcctactcctgggcctcttgcgggtcaact

SEQ ID NO: 2546 - DNA, 869 bp, Homo sapiens
ctcatcagcaatttcaattttatgttttctacttatttttatataagaatacaatgcaacaaaatattcatatattgcacaaacagtgatgtgcatacaaagatgctaacaacattggctggtaataggctttaccatgttacgatctaaatgcttgttcatcagagaatgtacaaaattctaagtttggcatccaaaagggggcttacagttattgaatatttttcccagccctattttaaatcaaattcaagtttgcctatgacaaagactgtctataagtaacagggcaagcataccaacatcaaaattattcttcttcttatctcatgtgcccctatttctcccaaataagtgacaaggagagtaaaaggatcactgagggaacatttgaagaatgctactaagtgccaggtcctgtacaaggtaattaattactacaaacactctcgtgatggacatggccaatagtgtattttgtcaaaaaacaaaaacaaaacccaagattccagaagctgtttctgacaagaagtccttgtttcagtactcttcagtatgagtccttacttgcaggactgaggaatgaaattgagaaagaacctttaatcattagaaaaggacccaataaaactatacttaaatggatcattaatgtggatttttttacattcgtgtgggatagagaataatcccatgggaaacaaacacattttgaatattttttaaagaagtagttctgattctaattttactgtatgtttaggcatcattaaggacctctgatttgaaggtagatttatgtgccagggactccaaattcatgacatgttttaaggctccatattccatgcaaaaatggacttactgag

SEQ ID NO: 2547 - DNA, 1000 bp, Homo sapiens
aagcagtcaggagatttgagatttttattgagaaaatagctattttgacattatatccagtttctcatttatcagaataaattctttacaatattgatcaccatcaccactttagtgtatttgtacatagtctctgagtaaaatatattcacactcggcaaggctagaatattgaaattatggccaacattgcttactttaagattgtttactttataaagaagctagagtagttgtgcaactagaacagatgtttttaaaatgtttgccattcaaagataggcttggtgggacaaaactaatatgcatactacatacatatatttcttgtcttctttactgtcaatctttcagaacagtaacatgacattacaaacacctcaaattcccacttcaaaatgaacagaaaaatggaaaaacattatttcccatttcataaaattaaaaatcaagtcagaagagaagtaaaactcatttttatgcatttaacttaaaagcttgaatacacgactcctcctagagagaaggaagccagaacttcagaagtagccagtggtccaaagaataaatggccccatgaccttctctatggttcatgacttactgagggctgatgcaaactctggcaagttatttttcatgatttccaaggatctgggatatgtaaacgaaatgattaaaagacatttctctgaatttgcaagaagacgactgaagaatcagaacaaagatccaacggcctttcacgtggctacatgttcaccattacaccacaactctaaacccacaggcgagctttctctcaaatacacattcaaaatggtgttccaaataatccaattgtatacattgcaaagacacacaaaatgcctccttacacacgattagtaatctggttttagactctgaagtgataccaaacatatttagctaaccctctcaaaattgcaggcctagtgaggtttaaatgttttaggatatagaatctgcttagaattta

SEQ ID NO: 2548 - DNA, 518 bp, Homo sapiens
acagtgcaagggttttaatagtccacactaaaataggctgtacagttttgtagtttaacattaaaagcaatcctgccttattttaaaatgcttctacttaagaatgcttcttcctcccccactccttcacttaaggtataagtctacccctaaagtgcatttctcaggcattaaaaacagcactgtgatttgctttccacagagtcctaaataacagccaccttcttcatttgagaggctacagagttcaagctgagctgtgacaggagccagggggccagggccccagaatagctttttgaaaaaaaataattatgccaccctcctccgcggcaggtatcttctcttaccacaaataaatatttaatgcatccttggagtcatgaaatattgagaacccaattgacacttcaatttccagaaaaataaaatcatgaaggcattgtgtaaatattctgaatttggtggaatgagacaacgcgtaagggggcgggcctgaagtctcgggtttggaactg

SEQ ID NO: 2549 - DNA, 1328 bp, Homo sapiens
ggagttttaaaaaaatttattggctatgtttgattatccacaacagaatttcccttaattagcacaggaaattgaaagttggttataatttaatatctctgctcgtcttcaacagacatactcagcatttatacttgtaaatagaattgagttttcattgtttcgttttctgtttttgtttccttaggaacaagaggatgaaggaaatatggtcagcattttaataacaccataaatccaagataataagtaattctataaagttttccagtttcattaattcagaatttcatcatataacttgaaatccaattggcttcctctttcttagaaacaaaaaccaaagaaacctttttctgaaagacattattttccagtattaggccaatttgtcctcaaattaagtagaatctcaacatcttgttgagccagtttgtaaattccaacttcatttaatgctgctgtggcaggaagctgccctgaagctgactgcagtacatctttcagcagtagtgcagaaccgacgttcaaattcaaaacaatacaggcttcttttatatgtttaaaataattttctggtctcttgcaatagtgagaaaacaaagggaaaagattccgagtcatatcaaactcgagctgggctgctcctccttcattgaagtgattagcaagaattatttcttggtagatgtatacatccagcttctctacaagcatttgccagaaaattttaaataaggagaaacaaagctgctgctccaactgaagtaaatggtctcgtaacgtcagcagcaacgggcaagccgaactggacagggacatcactgcctgctctgactgagatggcaaggacaaccatctttcttttttatacaattttgcagcatctttaacttctctaaaaacgtggtctacttgacgggtcaacatatcatgctttaaacgttctaagaggttaatcatgtcatcaaagacagagctctccatagaggctagctgtcctagctgcaatttactcagagtattattctctgcaaacacctccagtgcagcctgttgaagttgtagaaagaaaacattgtcagcccaatctgctagtactgttgagatgtagttcacagcattaagaattgcacagtatcgaaagccaagggaagctctagtctcttctttcatcacttgtgttaatcgtatcctaaaatcatctactaagtccttctgtaactccaggaactgaagctttcgggaagctgtgggaagatttttatacctgtcagttataaccaagagtagagtcataaaagtttctgcacaatctggaactttca

SEQ ID NO: 2550 - DNA, 738 bp, Homo sapiens
ggtttggcatagtttattacaattagtgtgcgcataaaaccatgtaaactctacaaagtaaaccacttcccctccacactaaccagcagctagtctgccatgaccttccagcacccccattattttaacatatatacatttcacaggatgtaataaccacacaaatagggttataatacattcttcagggaaaaaaatttttggtccatattttctattaaaaaaacacacacacttccctctttggcaaaagaggttaaatctcccatagttaactcacaaaagaaactcaaataaaaactactgagcatgaggtacagctgatgtctggactgttctggaattacagacgcctccttgaggggaaaatcatttcttataaaatgagatcagtttccaacagtttcatgtcagtagaaaagctcgatttagacttggtcagaatcacttttgcatgaacatgttccaaataactttgtttttcagaggacagcggaagtcacgaaaatgtgctacttctgaagaaagtcatgaaaattgtggcgtctgacctcagcaatatttttaatctgaggtacgaaaacatctgacacagccattcacactgtaattcctgtgccaccttcatggtcaccggagctgggccgacctcttcgcatccccctctgaagtggagactaaggaaacgggcagctgctgaggtgttgtttctttgcttgtttttaaatctacagtcat

SEQ ID NO: 2551 - DNA, 469 bp, Homo sapiens
tttagtctttttgttttattcaaatgtcaaaatgtaagttccaagatacaaattatgtttgatttaaaaacatcgactatgctttgttaacaacttccaaagccaaatgtaagttgttgtgactaaaatgcctccccagtacatttctggaggattaaccttaatatgtttagcagctagtctgatttccactctacaaaaaggaaaatgatgctataagggaaagataatgaacaaagttataatatgtaagacttcctgggaagaacttgaaccattactagggagaccaaggagaggtgtttctgttccatactatagcaaccagccttaacactctgtaatacaaagtgcatttctggtcctacccagccataaataccatacatcccttttattaattatatcaaagaaagcccaactcttcatcaacaagatttagaatttcctaatagctttagtttttccc

SEQ ID NO: 2552 - DNA, 751 bp, Homo sapiens
ccacaacatcccctttttattgatattaatcacagttatgaggtcttgtccatcagaaagcacaatttgcattatgtagaactacatacaaagacataaaaataaaacatacatacaccaaccaccacaccagttaatctcaaccaatcaaacctctgaatgtgtcttcaattttgatcatcagtgcttcggaagaacgtacatagacccagcccaaggttggcctttggggtctgatagcattcacagagcaggagattcacccttggaagcaattgaatgtgtaaactctgagagcagacactgacaatgcaatgcctgcatacctgactcctgggctgccttccttctcagcagagcccactgaaagtctcacgtgtgcctttaaccaatgaggatggcaggccttatctgtgtttgaagtggacaggtcattgctacccctgttggagaagctatgtaagaaggagtaggctggcttctggtctagttcgactcattctttatagggacatttcagaatgatgagttggctaaaatttactttaaaggggaaatgtaaaattacctcttcttttcctatccccttcttcctttcccatcctgagccctctggcaaggcctgttgcagctcaagagtttttggtcagattacaagttaccaaatggtcaacagggaaggacccactgcagattccaaaagtctttcattcacttgagttaactgaaatggctccttctttgagtaatt

SEQ ID NO: 2553 - DNA, 492 bp, Homo sapiens
ccaatgccaaaaactggtgatttatagaaatcaccctggtttatttttttcaacaaaggaaaaaaaaacatggttcaataattcagcatttgggactctggcaagtactgtctgcattgttcaaaataagtgttcctggctgtgagctctgcaacacatactgatggcccaggaaccttcttccatggttctaataaaacaaaggacccacacatggaggttacgtgagtcaacaaaagatgctctatcacaatgtgcgtaaaaagcaagtctttgaaaaatatccagatctctaaaggaatacaaacactcctatttggttttgtttttgttcatcttcagtattatattttagttgttgaggaaaattttttttactgtaaggaaggagttatatgactttataagtgggaaccaacaggctgccggctaatacatacgctttccctccaagtcaagtagctttttccccccgaaagcctctttcatgat

SEQ ID NO: 2554 - DNA, 979 bp, Homo sapiens
tctctgtaattctttattaaaaatactgctgtacacatagagactgaaaacaggattaaagatgaataacacaaattgggtcatgacattagaacctaacacactggtgctttttagggaagttgttgacatccaaatcacagaaccaaggtcaaaagcaaaatacaaaggtaccctcaaaaatatttacaatgaagtaaatacactaacagaatttaaaacaggtacaaaatattgaaatgaccaacgttacatgatttcaagggttgtcctttctgtgcttttatctgtcacgacaggaaggtgtggaaagtttatatccttaatttgactactcttggatattaaaatctttctattaattaaaaagacttttagacaacctcttaaatggaattacactatggaaaacagggctcccccaaaaacacctaggcagaactgagagttctttgaaaaccattcccaataaaaactaaatgaaaaataaatataaaacaaagcttaaaaaaatatgcattacctgacaccaaccttttctggctgacaatatttattcatgaaaacatatcagctgtctaccttttatatgcaaaccaagtcctgaggttaactaggggctgaagcaaactagcatttaggatgcaaacattcttggatttgtgatgtaaacttgccttgcacagggaagtttgctggtctatacagaatgagaaattcaagccctattttaacccctgccctctttagctttcacaaaacattggtccacaaattaaattttcaaaaagttcccagaccccaaaactaaaatagatgatcccctttcattttcaaagaaaacaatattggaaaaaatctccagcccgcttataaattaagcatttcatatttcttctagaatacaagtagttcttttttgtacaaaagaatacaatatgatttgtcaaaaaacatataaaaagacagctgctcttcc

SEQ ID NO: 2555 - DNA, 939 bp, Homo sapiens
gttactaacgttttctatttattcattaataaaaagtgcatagtacaagccctttatcccaatccaagtactcagaaaaagattaacaacagaccctggatggcacagacataatttgtttggcgtgatttaaacatataaaatcagtaattaacatttagcatatcacacgaccacttttgcttttaacaaagtaatcttcacacatggtaacaaatacctatgatttttcatttagaaatattataagaagactaaacttactattgcaacaacaaaaatttaacccattaaactagaaactctcttcatttttccttcttcaaattactgttttgtgtcttaaactgagttggtcaaatttgagcacataattcatgtagagtgacagactttcatttagagtgatagacttccaaggttcctttgaaaatttaagatactggtaattccataaacactcccacaccacataccacaaaaacactaaaagtagccatagaatagctgtattcaataattattttggaaaatccacattatgaaatatgacttgctgaccatggaacagtgcttggatagataacatgaaaaaaatgaaaaacatcttttttttttttttttgagacggagtttcactcttgttgcccaggctggagtgcaatggcgtgatcttggctcactgcaacctccacctcccaggttcaagtgattctcctgcctcagcttcccaagtagctgggattacaggcatgtgccaccacaccaggctacttttgtatttttagtggagatggagtttttccatgttggccaggctggtctcgaactcctgacctcaggtgatccagctccctcggtctcccaaagtgttgggattacaggcatgagccaccgtgcccagcctgaaaaaaatcttttactagaaacagttccaat

SEQ ID NO: 2556 - DNA, 522 bp, Homo sapiens
tattaccacatccaacttctttattcttgagaaaacaaaaaagtccaaaatcaaaggaaagcacccgttttaaaccctcatatctttctcagggctcactgcagtctggccatatctcaagcaggtctgtccaatggcttggaacatagacttttgcagtgaaactttaaaaacattacttgaattaggattacacaaaaaaaactaaattctaagtgagcacaactatcgctgagaccctgaaatttcaggaaataaacatggttcaaaactcaaactgttcatcaaaataattacgcaggtcagccaccactgcagaaccatcactgctcagaggaattgagtcagcaatgactgatctcatcatctcttcattagcacataagcggttcaacttgggatacgcaaggagtctctgcagaggtacgaaaaatttatctccaacacagaagggtgtgggagagttctctatcttggccttctcaacctctgtgaagactggtccaaagcatgggacagggg

SEQ ID NO: 2557 - DNA, 686 bp, Homo sapiens
aagtttagggcatttatatatctgcaacccaataaacccctggtaccatgcagctcccccaaattcagtgcaaccaaagctgctgaaacaagtccagccccagaaggtgtagtggcactgtggtgttaccttatttttatatgacccttcaaaaaggacactgaaaacccagtgcctgtttgcagagatcatgtgtggaaattgaaaccctgtctttaaggaatgaccaaattcatgctacttaacctgaaaacttgggggcaaagtggttgtgattatctgaagggctgctatgtagatgaagtattaaacatgtcgtaggcaaggtttagaggagaatgtggtacttaaccttctatagatcccacaatgaaatgacctgccttgtgaggtagtgagctccctgtcaagagagattttcaagcaatgggtagaagaccacttggcaggagtgttgcaaaaagtgggctaaaccagatttttccaacctagtatggaggaagaggcagagtaggggaaggtcctgcccctatgagattctcctgattgcatgcaagatgacaggtaatccctgtgtggacagactagaaaagcagacagcccctaaaatagatggggagaacttttagccctgatatccacacaaactattttaggatagggtagcttggaaaactttaagcaaa

SEQ ID NO: 2558 - DNA, 1023 bp, Homo sapiens
gtggttttaatctgtgttttgagatttttttcaaatggaaagatattacagatagaaacacatcattctaggtttcaaaatcaccaaagtcagtgagaagaatgtacattcatttaaatgtaatcatttgtaaataaagaaatcttgaaaaggctgaacagttcaatcaaattgaagaattgatctagatttttcattattctttttaaataatgagtaagtgtagatatagtgtacatacaagttgacattctgattcattcaaaatagtcacatccctttgcttggttttggatgttccagagactaaaatttaataccattcataacatagtattttcagtaaaaagaattatagagcaatgaaaaatcagaagatggctcagagagccttataatctctaaatatacacacatttataacctgcatttattttctaaagaaacaaattttaagtaatgctaatttaaccaatggagaaaaaacttctatcaaaatatacaatttccattacagactagaaggctaatattaaaaaaatagttgtaagccaaaaagtttgcttatatggatgacaggtatcatctccttgaagcacaaagcatcaaataaggtcttataaaagatcaatctgtgaccttcttcatttttaagttcttgataaattcataaagcttgagtctcaatttccagaaatggaggagccaaataattcagaatctcaagtgcgatttatgctttaccatgtacctgtccaatgtttcccaaaaccgtaagaacactggtctatccaaatgacgtttgtgatagctgagttctaatactgttacatcccatttctgaacatttggatccagacgaacttcatcatacttcagatggaaggctttaacagtcttgaggcataagtttaaggggctggtctactactctataaggtactgtaacactaattgcagtgccccctggttgcatctggtcttttcttctttgtattagagtttcattttctcgttgacaac

SEQ ID NO: 2559 - DNA, 580 bp, Homo sapiens
cgtaaaagaactaatatttgcaaagaaaggggacgaggacattttctaataagcattagccaggagcagccacccccaagtacattttattcccaggtatatttattttgggactaatagcaatcaaaacagagtaagcggaaggtcttttttgtaagggtaagatgactgtgttcctgcagcctggacactgactgctgcaatgaaattggatctgttgagcatgtcttccaaggacagatttggatagtaagccaggtagaaggccagagctcccacaaagctgtcaccagcacccgtggtatccacagccttgactttctctgtgggaatgtgctttggctcaggttctgtctgtgacagcaccacacatccttcagcccctaaggtaatgattaccacctggcagccccttttcaagagcactaatgcagcctccccagcatctgcagcgctgcccaccgtgaggccagttaaaatctcagcctcactttcattgcagcagaacacatctgagagggtgtagaactggggatccaggtcagcaatggcaggggctggattgaacaaggttttcact

SEQ ID NO: 2560 - DNA, 706 bp, Homo sapiens
gttcaaaaacttttatttactataaagacaaaaacaccaaaataggtacaaatactataaaatcggttcaatggggtaaaaattttaattaaaatatctcaatatatttaaaataacaaaggatacatttaagccaaattttcttaacccagagattttttttttttttttttgtaacatttgcttacacagtaaggtgctaatagaagttagcccttaagccctggaaatcttaggaatcatagtcacacagcaaatataatttcattgtgaaagtgaactttggtagaagaaaaatctataggacacctgaggtagtagaaactggaataaacagtagtagacgttatttacaacttgagtaccaaataacattaagaacacaaaaataattacacgatacaatttccagtccagctttgatccaaagaaaataagaatattacatcacatttgcattgaaaacaaaacaaaaaacaaaacaccacaattaccagcaagctgagggaactgcaaacaaactcaaacacaatggattttgaaatctacagatagtttgagtttgaaatgtggtgggcatggtgatctacaaagtaatactgattagctgaggttcctcagtttatacagtttacatttttgtcagacacagtattcatctgaccaatgatcttccagtacataaaatggcaagagtgcatccttt

SEQ ID NO: 2561 - DNA, 1132 bp, Homo sapiens
cacattcacataatttttattacaatatattgttataattgctctattttgctgtgagctgttgttagtctcttactgtgcctaacttataaactgaactttatcatatgtacgtacatacaggaaaaaacattagggtttggtactagcagcggtttcaggcattaactgggggtcttaaaacatatcccccaccatgggccaggtgtggtggctcacccctgtaatcccagcactttgggaggccaaggcgggcagatcaccaggtcaggagttcgagaacagcctggccaacatggtgaaactcccatctctactcaaaatacaaaaattagccaggcatggtggcaggcacatgtaatcccagctactcaggaggctgaggcaggagaatcgctcgcacctgggaggcagaggttgcagtgagccaagattgcgccattgcactccagcctgggagcctccagaccaaaactatgtctcaacaacaacaacaaaaaaaatgaaggccgggcacggtggctcatgcctgtaatcctagcactttgggaggccgagacaggtggatcatgaggtcaagagatcgagatcatcctggccaacatggtgaaaccccgtctctactaaaaatgcaaaaattagctgggcatgtggtgcatgcctgtagtcccagctactcgggagactgaggcaggagaatcacttgaacccaggaggtggaggttgcagtgagctgagagtgccccactgcactccagcctgggtgacagagcgagactttgtcccaaaacaaaataggtgaggggatagcgaatgcactcagggtcagcagtggagtttaaaaattgtctcttttcaacttatttaaatgacagcacctgagaagaggaaccgttttacactggatgtttctcatgtagaacaagaaatctttctggaattgatgtttacatgtctgttgttggtcatctctcctgtgtcttaaatactttaatgttggaagagcatagtgtttgggctagtgggtttctgacagcccatgggaatgccctgaaactactgtatctgatgtttgttttcgatgaggttccatgttttgttttcttgggaataaattaatatattgttttcc

SEQ ID NO: 2562 - DNA, 522 bp, Homo sapiens
gaaaataacaaaaaaaccaaactttacttgcatttagccattaataaataatttacagtatgtacacgcggtgacactccacacaggtcgcagacacgtggacgcagtgaggggtccccacttccaagcagaacgtgagcaaacacaaccaaaataaagtgcttcactttttacttccaacatagggaccaactaaaaccagcagggagagggaggggccgggccccgagcgccctcccacccgcccacacacggttctggcagagggagcaggacctcttggagggagggggagacacacgttctgcagcctcctggccagtgtatgagaggtccctggggaacagcagaggggctgccgatgggtgggtagggtgtggagctgtagggctgctggcaggatcaccctccagggcctggctgcacttttgggagtgaagcctggctttgtgctgtgggcatagcagcacaggtgggactgttctgggcccctggatgagcaccctgggctgaaatgagcgg

SEQ ID NO: 2563 - DNA, 547 bp, Homo sapiens
aaagaaatatgtttatttaaaacttacactgagacaattagtagctttaacagagaacaagatagcttcaggaacataaaacaagctattttacaatgtcatgtctcaaggtgttctaaatgctacatctcctctgacttaaggggagatagtgaagattatattttcagtagagtagggacctggatactactagtccaaaaaacttactgcatcaactcaaactaaatgtttattttacaaataactcaacgagcccaagcacacggatcataaaatcttcaaacacctagcaagcactacttttcacgagtgcattatgcaggaggactaagttaacaagtgctctgcagtctgtgcttcaatgtaagacattcgtagtgatggtcactgagtaagacaaaaagccctacaagtgtaataaacaaaccgcagtgattttgctatctaattaaattacttgaagcaaaatgactactaggttatattactgttattatattacatcacccaactatgagctgttctgtttccaatgaccagaaca

SEQ ID NO: 2564 - DNA, 581 bp, Homo sapiens
taaacaacttagataatttatttagaaagtagaaaataaaaagtatgattctaacatctatttagaatatgaacaaaattagaaatggttaaactacagaaaaaaaggcagagaaactgaagttggcttaatggttatccaatacaaacaagcaaaacccaagttaccttcatgcaaataagcattaaggaaaagaatacgggaatgtttacagaatgcgccatggcaaacatttttcaaatttacataagatactgtacataaatgaaaaaataaattaggtaatttacaagaaatgttttacagattacaataggctataacttagtttattatgaataaaatttatggcacatcatacatttttacatcacagattcagtgttaaaagaattcagacatgataaagcttagacttgacaagaatgatgtaatagaatgaggcaactgaaactgaaatggcatgtgtaagtaaaattaatccccaaattaaaggattccttagattgggacataataacatcttctgagtacactttggtcaataactggtcattaagataaacgccattcaattttag

SEQ ID NO: 2565 - DNA, 927 bp, Homo sapiens
aagcgaaaaagctaaaagataattttttgttaagtaatgaacactcgtaaaacagcaatgaaatggtattaaaatgtctgtgattacttatttctcagcattcatctggtaacttaagcagcatgaagcaagagttgcactttaaaaaatgacaagaaaatagctattcatttagtcgacagagtaaggcccatctcatttccaggatcactagtttctgcttatgacggggtgagcatccgccagcgcggtgattgggaggcgcccctgtgtctttaggctgaggcagtgcccatagctgcagtgcctcgagtttccggagcaaccgcggggctctttcttgaggagtcttgggaggggcggtggcctgcctccccatcctagatcagcgaggtcccaagagtgcgtattgctgcggggtagctgtggagtgtagacacgttccggaggtggcttgacatcctgaggctggggtggtgtgaagggaaagaaagaggggcaggtcccgggctttgctggctctgcttctcagggtcaggccaatgggtctgcagagcagtgcagcgggctcctgccagccgtggtgttgcctctttcttcccagccccattctcgtcttgcagggaaggcgtgtggactccggggggcacaaaggactccagcagggccacagacagaagagtgatgtgtcccttgtcctctgcctattgcaccgtattccataaaaaataaacacttttttggactgtttgtatattgctaatgcggtggcactctgggcactggcaggctgcagagagccgcgttgccattcatccaccagaatccatccagagacagccttgcgggctgggatctttggagctttcctttggaaggattagcagtgcccgtctgtctggtgctctacacagtgctgtgaacatg

SEQ ID NO: 2566 - DNA, 519 bp, Homo sapiens
cgttatgaagatattttcctttaatttatcaaacatttcacattcatgaagtcatttacttcagagcaaatgtaagcttataatattaaaaattaaagtattacaatatttacaagatggttggcaggggacacttactagtataaaaataatacaaatattgtattttcctcttatctgccagtaaaaatggcaaacagttttgtctttctgaagtttctagtcaataaccaaagatgaggagcccctaataaagtgccttgccctgtatgctccactgtctatagctttagaccctcaacattcttcttcaagttcagcagctctttttcttgccttcttttctccagtttaaatgctaatttgttagctttcttctccactcttcgttccttgcgctcttcttttatagcttgctttcttgctcttttatcttctttgctttcatttttagaacgtggctgagttgatactttaggaagatcactgccattaatcatctgtattctttcagtttgc

SEQ ID NO: 2567 - DNA, 1021 bp, Homo sapiens
aaaatatcaaaagaagtttattaaaatacatattttgttatacataaaacttagaaatatttcaagatttacatacatcaacttttgcaatcttcctgctggtaaaaatacaaaacagcagcataagaaccagttactcatatactcaactatattcatgcatacttaacaaaatgaaaagttctcctaaaaactggcaagatacaaaatgtcaaatctaaaatgatatatatacttacgtttttagcattcttacagattacaaacccttaccaacattaatcttggcctactttaaagttgagtgatagcatgaactctgaaaagagaatgcatgggttttctcacagctatatggccttggacaagtcacttgtcagttccctcatctacaaaaagggggttaaaaatattcacatcacagaaatgagattaagtagtttaacacataatggctaacatttcattgcttacgtgtttttgaaactacagggcacttttatggtgtgactagtattttaagtaatcagtgcaacttagtatttttatctctagctgagtatgtgtctctccttacctctactatgccctttaaatgttctttgcccacacaatagttaattgtgctaggtataagtctgattctaataataaattgatataatacagtcatcttagtgttaagacttattctcagtaggtaagagttttagaactagttccctgaaaaagctgtatttatgatagtttatgtgcaatctgtagggccaggagcatagtctaatctgacccagaatgtctttttgatttgatataggtaaggctcttcggtgatccaagagcagccgctttgggatttctggaaagcaaatcaacctgcacttagagttgcatggacagtgggccaaaagtcgtaacacatgcatcataactccagtccctgttaaagggaactaaagggctttgatttaattggccctcttaagcaaagctaataaaagattaagttgttgggccgggc

SEQ ID NO: 2568 - DNA, 1032 bp, Homo sapiens
aggagatatttaaccttttattgtcctttagagcacatctcaatttggactaaccatatttcaaatgctcaacagctacatatgggtagtggctactgcactggacatcgaagttctagaactctctcttacaaatgaacactatcactgtcgttgaaaactttcttgagatagtttattttatacaaacaaactgtatttcttattattcctgaaatatctcatattggcatcctgccatttcattgtagtgcctatcatttttccattgatactgataaagttgcctaagacacaacttcctacatagaggaaataagaggaacaaaccccttttggacagaatctattaaaactcattccactatccctatgtacataaataacattgcctctgctgagtggaatttgcattcgttacttcaaaattcagactcatctacctttccaagttagacagttggggaaagaacttcctaaatcttaaggttgaaggcagagggctcaaccccactccagattcaggcaaggggaataggaaagaaagtgcgagataagagcatggtggcctcttggggtcccttgatgggggctgttgggaagtggaaggcattcttttaaggggataagaagcaaatggaagacttgctccaactctagagttttcagagagttagaggaggtggagagatttactcctgccatggatcatatgcacttctaccatcaactcctggttttgcagtatttttataaatggagtttggaccttggtgacactcagcctctcttccccttttcctatgttgctcaatcttcctttccctcctaggttcttacacatttcaaacccttgccaataacagtattttagttatcaggtctcaccattccctctggttgttgagcctttggataaaaatccacatggctatggagtgggttttgttggaaaaagtgaccgtcctctaactgcacctctatttctggctcctcaaacagcaaagggtaataataaggcatggtagaggt

SEQ ID NO: 2569 - DNA, 648 bp, Homo sapiens
cccagtatacagagtctttatttattggaagtcctgatatccaggaaagccgggcccatgtccagggctcaggactccatctggccactctgcaggggaggggcgggggggcagtcattcatgtccagttttcctgccgtcagaggagtcctcaggaggcaggaagtggctgtgcctccacagttgcaggtgagcgtggcggctgcacctgctcagcgcactgcaggaagcggcgcatatgctctgcacagttgcccacagctgcctcgttctgtcgaagacactcctcgaaggcctcaaaaggctgagcacaggcctggcggatctggcggatgattgggtgggaggatgtgcactgggcaatgctcatcttaaggtagtgacagtcccgctgccaggattccggcttggccgccacacactggccatactgctccagctcccggccacagtagcgagcggtgacctctagggccgcctgcatctcgagacctttgccggcgtagggctgtccggggggaacgacccgccttttccggtatcggttgtcatgcggcgcccagcccagcctggttttttccggtagccaattgaactaacaaccccgttccctttaggactaatctgtcacggcggcgccctacctct

SEQ ID NO: 2570 - DNA, 683 bp, Homo sapiens
cactgaatgcataaagtcctttattgaaaatattgggatagcactgcattacatatagtcaatatccataaatgaagggtcacacatttctgaatggacaatactgttttacatagagaacacagcatctggatatgctctcacaattatagtatcatggactaaactaggtcagagtgaagtatatgcaaaatgaccattttgtttttttccattttattaatagcatatggttgcagatggtgtaaatggtaaacgtgatatcatgagacattcctgatatctcacaccaacacattatttaacgagcaggttaaggtgaaactgccagtatgctgttagtcaagagtcctcagtaggagaacttgagtgaaacgtacacccaggctacagatttaaaattttatagcattcatttaaatttgcatggaattaaggagtataataattgttgatctgacaggaggccactggacaatttgttctctttcacaaaatgtctaaaataggagaataatgtaaaggaagtattctaagaattgcttttttaaatgcagatatgtaaatagtacttgttatacatttttcctttcaaaaattaccggggaaataatttatgacagaccatttttcagctttggttattatttgaaattttttcctactagcaagcagtctttggc

SEQ ID NO: 2571 - DNA, 870 bp, Homo sapiens
gaaagagaacagacttttaatgatatttttaaaaacagttcaggttggtgaagcagaaaagggatgtgattacaatttaaatgaatcagtcacttgcacaattaatcctcttggcatcatacaaactgggttttaatggcaaatgatgacatcatagcatgaccaacactcatggaaggcagtctagagtccatcacgctcacacctgagggggaaggcactgcacccactgacgagacgcagagaccttggactacagatgacaccacatgcccacttctccttcctcaccttcctatggctactcctagtcacctgggacccaggccttggctgcaggaacagactttttccatcggcttttccagggcccaggtgaagaggccacttcagcaacagagggtacaggagagagtttaggggctggtggagattaaagtgggataagtgtatctaaatagacttatgtacactaaaccaatgaaggagaggtttggctttaagaaataaatatgcccccaaccccagaaaccaagctgctgagtaggttccacaggcgagatacacatttaacactcaccctgggccagtacacttgactggtttaattctagtacatctgtcatcactatacactgagtagaatacagtggataagcaaaggtttctccaccatggagagagatttgtgttgccacaaactgtttctgtcacccacccgtgtggggacttctgagaaagttttcttgttccaaggagccatgtgactcagcgcgaggccctgcctcagcagaagctctgagccagaagccacatatattgctggagacaacatggcacaagggaaaagccctgaagaggacaaaagat

SEQ ID NO: 2572 - DNA, 936 bp, Homo sapiens
ccttgtatgaaaagatttaatgaattatgagccattgatcattacaaactttaagccttaatatttcttctttcctatgtaaaaccaggtaattaaaacagcctgtctcagtatgacagaagaccatagtagggataatagtaacgtctgcttccacatctgcatgcttcgttaaccaaccaaagaaagtgctccaggtttcccaagtcaacaaagtatactcagttacactttccctgatcatactatgaattgaaacagaacactcctttgacttttaatagcacttttcatccacggcacaagcactttcccattattttctcctttaccctcaatatccttgtgaggtagtgaagggagggagcaaggatttttttttttctattttgcagatgagaaaactcaaggtgaattttacaacagtggttctcaaccttggcagcatattgaaatgaccagaaagtttttaaaaatccttatgaccagctcatattccagaccaacatcagaatcttggcatacggaacccaagcatcgatgtgtcttccaacattccaaagtgactacaaagtgtatacagccaacactgagaaccactggtttgaatgatttacactcaatcttcaggcgcaactgtcttctaccgaaatgctctcctcagcaccaatgacaaagatattccatctccttgagcactgcagcagtttaagattttgtagagctactactgggttttagtgacaaatttacgtaaatgaaggccctcatgacccagatgctcatgctgctcacttcaattgcatatgatttgcgaatgggacattcgggaatttaaatctttgagataagaatggcttgttgttaaatattgaggcaattatttcattctaggtccaatacgcaataaccatgtgtttcggttttccactcagc

SEQ ID NO: 2573 - DNA, 551 bp, Homo sapiens
gtaaaaatacatcttttaataaacattaagaagtacagcgcacttttattgaggttttacattgtagtttacagcaaatatactatccattgtagtgtatatgtacaagtaaagtaaacttaggtttgttttctctcccatggctggataaaccaaatctgatacatccacatttaaggttgttttccaagttggtttccataaaaggcctttaacaataataggcttttaacaacaaaaaggtatccctcccatcacaatgagagcttgatgagggctcaaaagtgacttcaaaaactgtaaataattattttccttggatggctttaaaaacagctactgatagcaaatcagaaacactaaagaaaaaagacaataaggaaacagctgtttgtctagtgaatccataataaataccaatttgaggctatagattacaaagccaaaatattcttataggaaagttaatgtttatatttacaatcccatggactaaaaaaactgtctaatatcttaaagactgagtctacctttatttaacattgtttata

SEQ ID NO: 2574 - DNA, 934 bp, Homo sapiens
catacaactcatttataatttattttcacacaactcactatgttacaaaactgtacacctgcccccaaagttggataacccaaagtcacattccttggaaagagaagaatcaacactgggccgctttttcaagagcagtctcttctggattgggcccaacaaggctagaccagaatgtggagtacaggaatggccattcttcaagtccgaggggtcaggttcttagcctggtgcttccagtcgttacaggaggggtgtctctgtttggaaagccagcaccagcacccagaacacaggagtccagagagacaggcaggcactgctggccaccatctggctgtggtgggaatgcccacggcgagggagccgcagttcagtggagatgtgcctgtccaggacagggacctggagttgcgggactatgtcactctcctccaggcggacccacagatcgctgaattgccggagtcgcggcctccgctgtgaccgcctccgcttcttccggaacctctgttcggcctcactgggcgtgtcggcacttccaggccgggacacaaggggaggcagcgttgagtgccctgaggatacggcttctggtgccggtacttccagggtagggacttttggagcaaagatggtggacagagtgggccgtgtggaggtctttttactcttccctttgtggatgggtcgtccagcaggggcgtgttctacctcatagccttcacgccgcaaaacatccagcactgtgttgttgcccatgaaatgaccagctccaaaggcaaagaagaagcctttgtcagggaactcctccaaaagggccttcacccgcttccctattctctcattccgcttgtagatcagctcccggcgtaagtagctgtcaatctcctgagcagtgatgcgctcctgaggtggtagcgtggcattaata

SEQ ID NO: 2575 - DNA, 555 bp, Homo sapiens
aaaaggatgaaaacacagattacactttattttaaaactgaaatgaattttaatacagaaaatgaagacagcattttgcaaatttatcactcaaaggggtatctctatttgaggaaatcagcgtgttacactttgaaagatgaaatgttacagcttgtacaccaaaattaaaaaatgaaattaaattaaaaaatgaaatggttaccaaggtaatgcaggtcaggggatcaaaggtgaagggtcacacattattaaaaagaaatccaaaaggacggctgcatcatgatctctcattagtgttccagcggtgcctctcttttggtaaacttgaacatttcggcagacattcaagcagctttttcggtaaaaagatttttacatgactactattgctgttcccatgatcatcttctataggtggcacggtgttgagaacacagtaggtgctagttccgcagaatacactttgggaaacgctcttccggcttgttttcggcagccatttcccctccgcgcgccacatcctcctcctcctcgcgaccgggaccccgagcg

SEQ ID NO: 2576 - DNA, 1048 bp, Homo sapiens
aaagtttttaataaacttttattttatattcaagataaagcatatacacaattcaatgtggaaataaattactagaaatactctggaaacttttccatttccctctcaaactcacttttttttaagctcataagtctttttacttgattttaagaaacatggcaactataatactaagaaagaactacagctttgtacagaaacatagagccttgtcttgactataaggtttagttggtgttttaataacaacaaaaaagcacaaaagacacaaacactcttcaacaggtttactcaaacagcttcgctcaagaagaaaaaggcacagatttaaagggatgacaataatcattaagaatgaagtaaatggagactcagtcaaaaaatgatacttcatgaattaagtcaagaaaaacaaaagtctttcaaattatctgtcttccttaaaatgaatttttaaattaaattgtataaacatatgatataaagttggtactttaggaagcgtctttgtatattttttatgtacaaatctttgtatacaatttcgatgttccttatatattccctatatagcaaaccgagccaggacctcccaactgcatgcctcaagtccctgtggagcactctggcagctggatggccctacttgctttctgacaaaatagctggaaaggaggagggaccaattaaatgtagtcatcttcaactggctctccattgacatcacaatagtggataaaaattgccactactcgctgaaatacacccttcttcatctgacgcatctctgaaatttcctctcctattgtttccatacagatgtctgcagacagctgtcctttccttctaggagcatagatagtgctttcttcatcgtcttcaaagtcgtatcgagcgaagctgttgggctctgcagctcgtaatgacctcagccaagggaagtcagaaatcatggaatatggagctccatccacaacaccttctaaagtatagatttctctccccaggggtacttggggtatttctttaagtcttcttcacttcg

SEQ ID NO: 2577 - DNA, 1307 bp, Homo sapiens
  Modified_base 1249: n = a, t, g, or c
gcaaaatgacaacatttaatgggatgataaggaaataagacttgacaagaaaccatagcccactgcagactgttcacgatgtcagatggttcatgatttttttccaggtttgatacagaagaatcagtttgttacaagaaatgcttctccaactcttctagtaattgctttgtctcactcggaaactgaactactgtcgatgttgtaaaaagctagggcatattcttctttttcatagtaatcgtagaccatggctggggctggctgaatgttgaacacaaggttgctctgctcaacagaaaaagggaaactgtctgctcgaccaaaaccattttccaagtagaaaagaacatggtcattcttgacttcagtcttcatcacttggcccttgttttcaagctcttcaatggatgacatggttggagtaaatcctgatagcatttttacatctataaccaccatactggatttattgcgaattccagtgtatttgagggtcactgtgaggtcaaaagcagtcgaagagtagttctttactatttccaaggaaagagaaaatccagatgccttcttaggtaggagaacattgtacttaagggtggcctggataaatgtacaaccgtgtccttccacatctactgtgtattgtccaggtgcctgtgttacttctgaacgttggaccagtaggcggttatgaccgttaacctggaaaatctcactggatccttcactgctggaggactgtgggttttaggtgtccaagaagaaagctcagatctgcgacgcaggtgccttacttgggatttactatccgacaggggtctggaggactgtgggttttaggtgtccaagaagaaagctcagatcttccagcagaaggtaccttacttgggatttactatccgacaggggtctggaggactgtgggtataggtgtccaagaagaaagctcaaatctgccgacggctggtaccttacttgggatttactggaggactgtgggtattaggtgtccaagaagaaagctcaaatctgctgacggcaggtaccttgcttgggatttactggaggactgtgggtattaggtgtccaagaagaaagctcaaatctgccaacggcaggtaccttacttgggatttactctccgacgggtcgatgccacccgggaacagaaagaaagcaggtcatttgcaatctaccggagcctggaggactgtgggtattaggtgtccaagaagaaagctcaaanttccaacggcaggtaccttacttgggatttactctccgacgggtccgatgccgcccgg

SEQ ID NO: 2578 - DNA, 1025 bp, Homo sapiens
ccagagacaacttctaagtttctctttatttcttttggaaacaacctccattcttcatctctcaatgtagtcctggcctagtgaaaaagaaggcttttctttctggcctccagagactgcttcctttgtaggaaaaggaacaataaacacttcccattaggtttctgtctccagataccaatcagggaatgactggccaggactggaacttaacggccttgagaacatgtgggatttgtctttgagccccattggcttgtgatgttttcctctgtcctccctgagacagttgctcctgtcctggggggctctgcctccacctcccagtccaggatgtctgaggtggttgcaggctgcttgctgcccagtttccagtctgttctggtccagggaagcaccaccccatggcccttgctgcttctggcaggggtcctcaagagctcaccatgtcccagtgctggctcatgagtgaggactcacatgggttgacgacgatttccttgccgttctcggtgccatcaccgaacatatctgtatcgaggcagaggtgggatgctatgtgctcgatgtgggaaccagttttggtccattgctgtcggtcatctccattcttgcaaaggacaagaaccactggggcgccagggaacaaggtgatgactgacaggcacagctcctcctggaggatcttctgggtgtatgtgaaggcccatacctgggactttgcatcttcgcctttgaccttggcacaggggctcaactttaggtttggggtttcttggttgttctgcctttgagattccaggcacttctgtctctgtcggatattgcccttctggatggaggactccttggggatgctgagttcagggtagatattctccaggtaccacttgaagctctggcagcgcagattcttcctcaggtccaatctgctctcaacattcccgaagggcctctccagggcgaatggccgggcagcgtaatagtattgcttgtattcatccatccacacttcagctgtccgc

SEQ ID NO: 2579 - DNA, 1176 bp, Homo sapiens
cagattatagctgctgttaccttttattgagtacccacaatgtgctaggcaactgtgctagatacttttacataatctcatttaatttaaccctcacaacaaccctgtgaggtaggtatttgctccattttacaaatggagaaatcgaggcacaaaagattaaacatcttaccaaagtctgcacagccacttatatgctggagctagaatttgaacccaggtgtgcctccactttttaatactagaccaatcttttcacgggggaagtttcctagattaacaccctcacatcttttaagaccattccaaaacctgcgttctgttttgcagaagccctcactgtgtttctgctgccctgaaacagtggaggcagacaaaggtgagtgccaagtgaggaaccataagaagtggtagatctctgtggagtgccataagaaccctcaagagccttaacaaaggtagttgggggagaggggaagaggtgtttcagcagctctgctcccagcagccatttcctctctccagggcaaaggggtggggctgcgaggccagctgaccaagaaacccctccagctcctccagtccaagtccagcatctttcctacaactattctgccttccacttcgtcttcttccttgcctcactctatgtcatggttacccttaccaactggttcaggtaagatggagtgggccttagatactctcctgaagagctagctattttaaggaaagagcaattcaaggccattccagacacacatgggtctgccattatatttggtgaggaggtagaacaggtctaaaagctaaggcccttcatattctctaaccagagcctttggttacacagctatgagggagcagaactggaaaagaccttcatcaagggtagctgggccaccttctgggtcaaggttgcctcatgctgggcctgcgtactcctctatctggggctgttactggcaccactctgttggccccccacccagaaaccccagccccttatcttcgagcgccgccgccaccgcatcatatccccagataacaaatatcctccagtctaagtccttttcacaaactggggttcccctgacattgtactcctagagttggctcaaggggagctgtccagcccagctcaatacctcaaggacacacagggagttatctccg

SEQ ID NO: 2580 - DNA, 1759 bp, Homo sapiens
gaaagaatgagggaagtgtttattgagactgaaatggaacactcttctcttttatgagttaacagcagtgtgttaagaggctggtttcaaactgactccaaaatgataactggcagctcatgaacagctctgccaactagtgccactaattggggcaacctagtaaggggtagaaccatttagcccaagataaattactgattcaatttcatttatatttagatttatttcctataaacaatagcaatatttgcattttaaaattcacattgaatcattatttactatttatgatgtttacataacaattcagtatcattatgttgtagatttcagatgtaggtcgtcaatactgagcacttatctactcttctgctatctttggcacaatttctcatttcttaaacatgaaagcacaggtttaagttggctacagaatactgcagaaacatgactattttggatttcagtgtaagtacaagtttatgttaagcattatttacaagatgagaactgaagtacagactataataaactatcttcataaattagcagaatgacaagcagaggatgtaatgaatagggccaagattactagttagaacagtcctcctggaggaggagacaagagtcatagaatggaactatttcccccgaaccactgataccagcttatgtcgtgggatttactctgcaacaacccaggttaggggaagctctttttctgcaacgtggcttgttcaacccatggaatctttattaaaatacaacttagttggtagcttgccactgttatttgggccctgataacagaagtgcaaggatggcaaagtactggcctctttgagtatgaatgaacttggaagaataaagccttccagttggatgaaagcacatccagccttttgtgagtgacagctttgtatgataatcttatgcagagctgatatggattccctccaggcagctcaaatctggaagttgtaaatgacatggctatgccaccttggagtatcaccataatacatctctgctttagagctgatatacagatgtgaaacgatcgaacaacatgatttctcattctagtgctccttagaaaggagttctgataagccccaaagcagacctgggttggaatcgtggttattattcaagtacaaggagaactctttatttcacattgacggttcaattctgatctctgtctggcaaattatatgaaaataataaatatatacatatatatatatatatagctctatgctgaacactgggttaacagttaccagcgtcccaatacagtacattgaaaaaagaatccttctccctttcttccaaaccctatgcccatcttaaaactgttattgcagaactatgctggtctgttttctttgaaattggctggagataagttaaaaattgacattttggcacattaactggggacaggtggtttagatgcattataatttataaaaaagtgagaggtcaaaggaaatccatgccaatagaaagcctgagtaaaaatttgtaaccaatgacagaatattttttttaaaaacccaaaacacttgtctatgcatgagaaagcattttctctttcatatccattacctaattctaacagttattactttatgtacttccaaactttgtctcttatagaatttctaaaacccagataatagaactttcctttaaattgatttcccttcaacttaccccacacccaaatcccaaaacccagagcgcaaag

SEQ ID NO: 2581 - DNA, 1001 bp, Homo sapiens
caggagttcattccagttattttaatgttatttactagcagtgtgccctcgtgcacattatcaaactcctctgactcttggaatcctcatttttcaataataactcacaaagctgtcaagcctaagggttctaacagctcgaacagcacctggaacagaagcaatagccgccactcagaggttacttcttccttctccgccttctctggatcacctccctacctcatcctcaatctaacgctggaaatattggatatggggtaggtcaccaaatgttgccagaagactcaaattatgccacccatatctcagctgggaagggcttaccgtggcctgactctcctcagggtccaagtccccatttatgatgtccaggcagaaacacttgtttctgacacatagtaggcgctggaaaatgttagtcaaatgaacgaggtctggtgtggagagaagagaaatcttgggagagtcatttaagggggtgcccagttgtcctcataaaaaacactatcatcatcagggtgaccaaagcagacatcataggcagggggtggagtcagaggctctaatgtggggactgccgccaagctctgcagatcaggagcagtggacacagcccgtggtccccgaagccgaaggttgattggagctcttccagggcttccttcctgggccatggacccctctgaggccattcgcctctgttccagtttggctctcctggacccctctggatggctaggttgttcctcctcaggtgctgggggtatcacaacagtgctgtaggggggtggttggtccaactcttgggggcggcactgggattctagtcccaccacggcctcttcatagactggcacttcaaaggcttcattgtcccctgtctgactctgtcttttcctttcctccggtgttagcccatgctccaggtggagggagaaagtgcacacaggcgcaccaaagccacagggacacaactgtctcagaagttcgtcgctcac

SEQ ID NO: 2582 - DNA, 756 bp, Homo sapiens
gggaatgttagtgcaatttaatcaccgtaagggtgacttttaaagatacactgatagttaaaaaaaaaagacaattaaaaaatagcattttgttttttaaatggcacccattaaagactcaacagtcaaaatgagacaaatcagtcctttagacgttcacagacaattgaaaggcactttaaaaatccactttttaaactaccacttgagaacacatggtagcacagtcttaaattcatcctagttgatcgggaatgatgaatgagtgttggcaccagaaaatcctgcttgcagaagggggcgcaggtgtcggtccacgggacagccactggccaggctagctgccgcctcactccgcagccttctgtggctaaatggcaggacggacacacaggaatgggctttggaccacaagctctggcatatcgggaggcaaagcactcaagtactctgcagtctagatgacacatttcatggtttggaggacagaagtaggtttccacatcacatgaaaaggacagtgtcacagtggggttacccagtaaacagctaccaaagccatcatttcacgcttccctgtagttttatgagctcgccctctgcatgtggatatggggaaagccgggcatgaaggggtgtgtgaaaaagaacagcctctgtgactgactgcagtaagctcacaagtttgtcactgtcagacttagcaagtcagcctgcaaaggttgtgctgatctcttggccacactacctactcag

SEQ ID NO: 2583 - DNA, 1717 bp, Homo sapiens
ttcattcaacaaatatttattgaacaactactctgtgtcaagtcctgtaccaggcactgaggatacaagaataaataaaacagtctctgccctcaaggagcttacagtctagcataagaacttaaaacacctcagaacctactgagaaaagtttctgggtatctagtatattgtctggaatactccaaatttcctaaaaatgtgaatctaaaatttatcaggaaacacagttgggcaattgaagatgcagtgaaatttaaaagaaaattcaaatattcaccctttatgtaaaaaccatgaaatctaaatgagggagaaacttaagaaagctgaaaatctacctattttaaagactttggaccagatttaaactttaaaaattattttattatctctgggtgacattttcatttatagtggcatttatatatacacatacatataggaggtgaatgtgagatatattccttagggcttttgataaaacccatatctttatccctagttcatttacaagagagcagcgtaatggtaactttgagattttccttttgacagtaatttccattatcatttgaatgggagaaattcttaggacatgatttggaatcatttctagaatataaatttcatataatcttattttataatgagacaaaactgtgtctttgtaacaatacgtgataatttaagcctatgttttaatggttattgacaaagtttaatggcatccaaaatactcttatgtctatctgaatttttttcctgtactcttcttttttcttaaaagcatgatagacccctctgcaaatacagagcctttgttgttgctttgctgtactttggtaccttgctgtttattccttagtctagcagcatccttagtttgtagtatatcttacttagttgcaactaaaaaaaattgctagcctaggctttaactgggagtttctattatctagaaggttactgtgaacctttcagaaaagtggaaagcaaccaaaagagctgtctcaaagactgtgtccccccagagtttgtccagctcttactgtagacactctgaacaggcacggttatctcatgtccaaagctcataacagcacattagaagaaagtggggagcctgttagaagcaggcatattgatagtgtgggagaagacatagcaaattacttagcagatattttaaaaattttaaaatccaacagcagtctgaggcaaatgattctgtatacctcagggctgagagaatcactttataacatatttgttatagccctttacattttatgaagtgttttacatacatcagagctggatacttataataatacattatgaatataactttaacttttcatcatgaaaatgtgaattatactgagcatgatgtttaagaagaaggcaggaaggtatactaacatacctgaaatactcacatcaaaaataattacaagttttaaatgttggcacttgagagatatacattagctatccaaaaattcatatgtacggtttccttcaagaccaacacggggtatcactgagtgaattttcacagcgctcagtgactgctggtcattaaatggggatgattgtcatcagtataagtatcacactatttgtcctgctaaatgcaagttaaaagatacttatggatgccactaccacatattctgacaaataagggaaacactaggcttttaaaagattc

SEQ ID NO: 2584 - DNA, 1334 bp, Homo sapiens
gtcttttctatttttaataccgagccattacataatccacacagtaattgctgacttgaaaaactattggcaacattagaaaatccccagagttttaaacaggaaaaggattactacagcacaaaagcctttggtagtttcactgactagtaaaccattggtaatcgtcacttgccagtggaagtcacatgggccctgggaaacactcccctatctcagggaaagcaggctgggggaagggatgaaatgcagcctcagctgggaggaggaggctgctggtggggtggtgtgctgagctctgagtggggctccaacaagtgacctccagccaaaagtgctgaaggagtgagcttcaggttgtcctcgggccaccttttactgcttttgtttcttgctagggaatgagtgaagtctccagcggcccagtcctttccctctcggtttcccaccttcctacagcctccaacatattcctgtaagagcctgagggagggtggactactccagttaaatagattttataaagacacaggagcagggaaggctgcctgtttatcacaaagacctaatccactcctctgcaaggctttccagacattaggccagaaccacactatttaattcttcaataaaatgatccaatgaaagtttaagaaccagtggtttggtttacaaccaagcagaagttaattatctaattgagacaaaattctctgtatgtgtatgtgtgttgggagtgtgggcagtgtataagatacagaggggacagggactactctccctgattttgccacttctgccacaatcctaaccccaataatcaaggaggatctgaataaccacatggccattcattcaataaacatatgctgaatgccacataccagactaggtgctggggatgcaacacagcaaaatcactgccctgctagaactgctaggtcagtgaaggagagacattaatcaaaatattacataaacatatcattacaatgataatgaaggcttatgaggggaaggtacagggcactaggagcatttagaataggggtatcggattgggtctgagggttcctagattatccttaggactccagggttcttttaaatcagtaccccttcttcttcccctcaccccactccttccttgcttcctgtagttaatatttactggtttttttctatgaggaggataatgccaggttcttcacatgcatgatctcatgtgattctcatgacaaacttacaattcagcactttatgacaaaggatttgctgagaaaggctgatccacattttgcaaggagaactatataaaatttatggcactgatt

SEQ ID NO: 2585 - DNA, 785 bp, Homo sapiens
cattcatcagacattttaatgagacccaatctgatatgaccccttcttgggggtagctcatcatccaaggagaaacaaacagttacaatgttacaatgcaacttgctaaatattgaacagaggtaattacataaagctgtgttcccccagctgctcccctgcttgtgctgagatcaggagagctgtaggaaggagccacaggggtaaaggatgacccactccagctgttggaatatgagatgagtcacatctggaaattctaatttggtgcagctgcccaaggcaaagtggtaggccttgttcacatttaactcggtaaagctttatgaagcacctacccagtgggtgccatggaggtggatcagattgagccacgctgctgccacctctgtggagggaggctggcatggatacaacttgatgactatagactcttcctctctggattcagttccctctttctagcctccttgaatggcctcagctcattttgtgaaaaaatgctgactgaggcctcatggaagttctgtgccgattcttaggtgcctgtgattcatctgtgcctgatgagaatcagggtcaagtacggcccaattctccaggcttttccaggcactggctgcctgaagccaatccaggtctgccaggtagagcacaagccagtcccatttgcacttcctgctgctaaaccacaggtccctgcttctccttaagagcaaccttctcccagagctgactacacttatgtctcatacccagcttgaaccaattttccaaatacaaga

SEQ ID NO: 2586 - DNA, 924 bp, Homo sapiens
actgccataaagaatattatttaatccatgagacatcgtccgtacaaagttagcgttacttttaaaaatgaagaccgtgatataaactggtaaaaaacgggcctgatgcgcctcgagcactccctgggagcaggccctggggtggctccgcccagtgtcgttctacctgaggtctacttgtgtctccccccttgttctctgcccccagaccatggccaaagcctttcccacaatgtcccatctgagagccttatggatgggctcacagggcagaggtaggaggagaaagaggaaggggcatggtgggcacccagccctgggggcaactgagggcacagccacgtccccagcaagggcacgctccagtagtagtgggggagaaggcaccagcagaggcagcgctgaggacctgggaagaaaaggaccctgccccaggagatggtctcagcaaggagcgggatattaggaactgagacccaagactcagagaggcaggtgccttgggtgtgcctgagcttgggtcaggatctcacaggcctcacgccccagaaaaaccccgccttaaccaaccatctcacgcggagtcagcctcgcctggcaggggggcacccaggtccagagcccgggccctgtcttgggtctctggctctctggcacacagagagcgctctgcagagggcagccctcgcaggcagaccctgttccagcagggctgaggggcagccgtgtggcccagcggtcagtgcagcacctggtccagctcatacttctcgcagaagcggctggtgaaggggaagcaggtgaggtgctcgatccagggccagttaatggggtagatgtacagccacagcacgagggcggcgaagaggccggcaaaggccagcagtgacaccaggatgagtgcccgcttgcggtacttgtcgc

SEQ ID NO: 2587 - DNA, 892 bp, Homo sapiens
ccattggtttatttgtatattggtccacaacacattgaagcctcacagttccaagaattttttttttttcatatttgtggcaaactgaggtagagacaatgcttggcacagaataggtactagataaatattagtggaatgaacagccgaagcgactgacttctaaatggagcagattgctcatttcacttctgttcctccacctcaacaaacctttacatcctcactggtttgtgaggccagagaacaggtgtggccttggtgtgataagaaatgctaattttatacaaactgaagcaatctggtctcaactttgacccccaaatgccctcaaaatggatcaatgagccagggaggcttgaggaaggagggagcatctgcccttccccctggccagaagagaatttgaatttgctttgagtagcttatgggcagggctggaaggtgcagttcatgactgtcagcagctttgaggctgatggaggcatggggaaggattaggggcctgggagaaagcattttatttccctgtaccccaccaccccaacatgggggagaaaaacacaacagcaaactgaacagagcagaggccgaggcagcaagaacccaaagacggaagctgcttctagcatcaggctccaggatgcaactgcggctctcagctctgccggctgagcttccagatcctgcgaagcaagtcaggttccttccttccctgccaggctggagtaaggaggctgttctaggcaggcagtctgcagctgctcaccaaggtctggaacaagctgccttccttctttgccgagcagatgtggatggcggtgggcctggctaatcaggggtgttctgctccggacaggctcatctagatttccatcctgccaaaagtttg

SEQ ID NO: 2588 - DNA, 895 bp, Homo sapiens
catctgctcaacagctcaaattatttattgtcaaaccatgctgtctatgcttaggcctttaggactactagggtcgtgggagcctcaaagtgtattctgcttggtccaggccttcttgggcttgatgttcatgcgtttccagacttcagctgtggtgcggtctgctttggtgaccccactgaagtcgaacgtggtgatacgggacagggtgcacagcacatattgcctataccctttctcttcctccatggggttcccatggagtgtcaggctacggagccgaggaaggacagccagcttattcacctcccccaggcgctggatgctgttgccgtgaagatagaggacactcaggttgaagaaagttgttaggacagggtcaatggaagtcaggtcattaaaggacaggtcgatccaggccaggttctctgggtgctccaacagctgtgaagccacctggttgaagtctctcagatcattgagaacattgttattcagccacagggactgggtcagtgatttccccgactttgaacgcttcagtggtcgtagtcctgtccttggctcctcatttaccagatcttgaatgacgtggatgcttctgaaggagtagtcaagagggggctcctgtaccgaagtgttcatatagtcccgtttgttcatagttcaggccatcattcaaaggtgcaagcaggtgccctgggagtctgggttcagcctgtcactgatggctgaaactccaccattaggcattcattcctgtgggttcagggattgtttccggttaaaatggaaatactccacgcagtcgcttcctctccagtcttggcgtcccactgcctcagggttactcagagcaactccatggcaactgctttcgtcaccacaacccggc

SEQ ID NO: 2589 - DNA, 1520 bp, Homo sapiens
catttatggctcatatatactttatgcacatagcctgaaggtaattttatgatatttgaaatcattttctatataaaacagtttgtgtacattgaaccataagaaagcaaatgtgtttgttaggtgtggaattttccactcatggtgtcatagcgttcaggaaggtttggattttggggcatttgggggttttaactgttcagattagggatgctcaacctgtatctgaatgggaaataaagactatattggaatgagcgccttctatttcttcttcaagtggctgaaggtatcatcctaagtctgacatattctcctgggatattgctttaaatatagaaacgcttggggcaaaagggaatttccctccataattcaactgttaagattctttctttgaacagtaagagactgagttcttgcacttgggtgaagaggccagactgagaggctctaatcctagcaacatcatgccctggtctctgatttcatattcatacagagggatgcagtaaaaaatccctttctctccattcttaaaatcagtggctttcacaatacatcaggtatttggcttaatctctgcatttcagatagaataccagtcatcttagaggctgaaatagggatcaccatgtcctactgaatgctctcaaaagacacctgcagcgtgctgagatccagcagaatctcatcaccattcaagcagactgagacccactcgcctcatatagaagatccctgacctcccggaaggttgaatggtggggcgcctgtgacagtaggagtgggctggctatgcccgtgtgtctacctgtgctctgataagaggcagggacagagcaaggctgaagagagccttgatcagctcctcaattccagtgtccttgaaccatagtccatctgtttgcaccctaggttggtgtccttgtcagtaaggccgagggaaaattcctcttgcctgtgtgacccaaactctacatgtctgactcaactcagaaaaagctggggagaagcccaggggtctggtaacttcacctgggagctgctgctgagggcacatatgtatcccggaggagctgtgagtttctcccccaactgagtagaggaaacagaggggaacaaggagggggtgctttgtaaggcaggtgtaacctggattaaaagacattgtactccaactattggatttctgagacctatattggaagagtcaatttagatggctagaaaaggaaaaaaaaaagaaatctaaaacagctttcaaaaatactaagaagtggcactaccctcattttacaagataccatcgatcttattttgaggtgaaaaagagccacaaatgggtcctttctgagacacagctatgaaagaaagaaaaaataatgtatccgaggaatttcctgtctgcccaggctgggcaaacactgattgcaactgagactgccctctgggatcctccgtctccaaagctctgtgtccagtggagaccaggaaactttaaaaaaggttaggaattg

SEQ ID NO: 2590 - DNA, 749 bp, Homo sapiens
gacgttgatataaagggcttttatttttacagttttctgtattttccaaatttctacataaacatacacataaaagtcataaaaatgtcccttaaaatgacactccctccaatgcagggagtgaggaggtgtgtgctgggacgccagcagggtggctgctggcagctaatccctgtgcaggtgcagccactgctacactccagcgtctgaggcccctctgcactggcagtgttagaatggctgtctgagagccaaggctgttcacccgagcagagtcatggagctggtacaggcaggagccaaggtaagcactaggctggtgtgtgccctccagggggcaccctccttgaagcaggccctccaaggtactcgccccctgaggcagccgataacagccggaagccttcccctggggggacctggccatttgtggagcagggaaaggctccactgccagtggaaatgtgaggccagcagcccaggatgtctgcttcccagagtccgcgtgggtcagtgcttgggccagacatggggctgcctgcggtggcaggacagtggcgggctgcctgggctggagggaagagcacgccagcgccaggaggtgctggggcagagctctggggatcctccccggctcctgaaggaggatggaggaacaaacctagtaacgggacccacttgcactgcaggaggcaggaaagcagcctgtccctgtccctggcttccctgtgagggacacagactcagat

SEQ ID NO: 2591 - DNA, 1020 bp, Homo sapiens
tagttttcaaaaaaatattgatctggatcagatgggctgataaggcccaaacacttataaaccaaagctgcaggtctctaaggtcttcagagaagctacacaaaatactatgatttcattagcatccacatatgtatcattttccacaacattttacaattctcttgtttcacagggaaggtgaactaattataatgaaatatcagtaatgtatcttaaataagtaacatgttgctggaaaaaatttaagttaaaatgcactacataatagtgcagaaacaaagtgcaggtggcaattttaagacatgaaaacaatgctgaatcagtagtgtttggagtgatacattttgcccatttttggccagtcctagaacagtactcaccacaagctgcatgccaaatatgaactaatgaggctaaaacactgaagaccaaatagaaccactctagagtctgtttcacaatgagatactcctccccgttctggaaacagcgatctgctgtagttcctatcctcctgtggcacctatccctgctacagtacctataaccagatgtcctccatcatccagcctccaggacaagtggtgctcagtgagtcacaacctgaggaacagctgctggttaccgatttgtattcctgtatatactcgacttgggtagccaggattttctcgtttgtcttgaatatatttacttctaaaaagactgttagtcttgttgggaggtgagcagaggaatgtttacttgctggagaacatagtaacaaacatcacttctcacccctcataaacagaaagcccattgtctgtgccgtgaaaagaggactaccttgtcaggaagattttacttacctctacaagaaaaaggactcgtattaaaatcgacctgtggttaccacccttagaaatgctgttttcagatattcctattcctagtcttagaggcagccatggaatatatagtctcctctgaccttggggtcaggaagaaagggaaatctattcataaaaggaattt

SEQ ID NO: 2592 - DNA, 836 bp, Homo sapiens
atctgttatcagctttattagggaaaacatcaggtctctttacacgttgaacaggaactgctggttaacaagacacgattaacttgctaggaatggacaaggacagcgacaggatggtgcttcacagtgcctcctgctgatggcaccttcattctggctgcagaattctcccaggaagggtcccgggctcttcaggaggcatttacttggaagtacaggtcagcgttatccaaagttgtccagcctccggcctggcccatgtcttcaggcagctctgaggcaagaataaaagggacgagttccctgccccctttttacccgctggatcagcttctacgacttggtcaaactatctttctttctgtctgccatgccaggaaatccagtgacagcaagacccagagtcaggcacatttggagggcaggtccatcggccactcctcacttctgtgggctccgatgccagcagagccacctgagcggctgctacctcttgccggaggcagtttcttctggcctcacccacccaaccatggctacgtcagggcagaagggagagaagaaagagagatgagagatgaaaggatttaaaatgggcaaccatctttgaggtttcccacatctgcaccgctccacagtgtgaaaagggctttctcactttcacatgatccctgggggctactatccccctgtaaccaaaagggaaactgggactcaaagggaagaagaaacgtgctcaacatcacgcagcactaggtctatgtccagtgctctttccagggtaacaggttgcttctactcattttaaaggactaaaaacagaaaaacagcaccca

SEQ ID NO: 2593 - DNA, 1220 bp, Homo sapiens
cccaacaggctctattaattacaatttttagctctgtacacgcaatgattggctggttttctttttttttttctttttcctttttttttttcttacagtaccatgggaacaacagtgattgacttgcaaagttttctgtctctatggaaaatgcaaaacagtactacagaaatacacaatgcactgtaagcagcggtttgctgtagtggtccaacaggtacaagcaaacattttggctcagctaggcagtaatccacttaaaccacatcccggggctacggccgacccaaccacagctcctgtgggatcaaaaagaatgggtctgtttaaaaataaaaattgttatgttttgtgctgctgtccaaaggactcaaaggacagagtcatgaggcagaagtttcccaaccagatctagaatcactgggaccacttccttcctttcccttctaccaacctagagacttggactatggtttcaaagtgaaattggcatttctaacaatgaatacccacagccctcacttctttaaatatcaacagagaggttccttccaccaaggctcattgcctcctccccagtttggcaaagggcaaccatgggcttctactaaaagggaggggggcatgctttccaaattggggatcttacgtcttcctcacaccaggcacactgtccccccattccatctactattcagcctccaatcagacgagacaacacgaaagatgcttgttgtctcttcctcgtagtaattgagcaaagctgtgatggcattgccttcaatgagattttatcagatgttggtgatgatcacgaacctgactgtctgtgcttgggctgtatttgagtaaaagtggccgacatttttgtctgtgtgccttcctgggccagggagagtacaaactgttttctgaaccaactataactcacaatataaaacttctttgtgtgcgcagtttagctataaatatccttcatttgcaatagtagtcttgtcatacagtttgcttacttttaggatcatcggcaaacctaatccatccccaagggtcctcagcttttacaaataaaactttgcatttttgctctttgcttttaagaaaaacttccgactacagtatagcactacatcactacatgacagtctatatcaaattaattaaacttaatcaataaattcccttacgtagagaaaatgatcaacagccccatttaacca

SEQ ID NO: 2594 - DNA, 1115 bp, Homo sapiens
actttgtaacaaaaatttattaggattaagtcaaattagaaaacttcatgctccaccacttgtcatatttacctgaaatgacaaagttatacttagcttgagtgtaaaacttgtgccccagagattctgtttggaaagcaaaaaaataattgatgcacatagcagtgtgcctgataccaccacagtgaatgttgtttaaggcctaacaaacagtggtcagcaaagcatacattacttttaagctttgggtccaaggaagatgtcattccctacctccttcaaaagcagactcatcatagcctgggcacctaggcctggagcctattttttcgagtctaatatgaacatctggatttcaagaggtgctaggcttgaggtatctttatggcttaaaaggcacaggtcatgcagctgaattaaaagctatcatgttggtctctggaatgcaggccatgagtcacgccttgtaagggggagacctgaggccctgtccttggctcctcagtgtaacccacacatcattggctctgttcctctcgccctgctcctgcactgctcatcagctgtgaatgctggaattggaggacaggttggggctcctgcacagtctgctgccaggtagagagcaacacaggctgcagaatcctaccctccagcatatcgcggggagggggggacctgctgcacagccaagaagtgactcacatgcaggcaaggacgggaaggcttgttcttcaggcacaacgtggtatggggagaagaaacctggttttcttggaatggtcctactaagcttgaaagtggtgctgcatttagggcagggcacacccagccataggcaacccctttgagcgatgggagaagtagcataagaaggatgccaagaagaacaataggttcttcaactcagtgtgggctctgggaaaccatcagcagtgggtacggaacacttctctggctctgccctggggtcactgagagcaaatgggagtcaagtcctcaaaataagaaacttatcacttactaaatagctgggcattcccttcagcttaggagcaaaatgtttactctcagaagctttcttttatttttaaactctccttaatggagggaat

SEQ ID NO: 2595 - DNA, 896 bp, Homo sapiens
gcagttatcagccacagtgatttattgagtgctttaataatacaagtgtacatcaactgatccacagtcaaaagtggcaggtccctaagaaatttacaagcactttaagtaaatcaaaatacatattattttgttcaatccaacagtcttctgcgggagggacagaaggctagtgataaacagagtctcagtaatgcacagtgattctgattgaagcttttgtacaaaaacttgttcccagtagcatgcacccaccaataaagacttcagtacaaaaaattaaccctaagcactacatttaagtagaaacgagatataattctgaatgtgttttcccaaagatcacataaaagaaaaaaaaatcaaaatcaaataaacaacaacaaaaaaaacaaaaccacacagtaatacaaagctttgtaagaaagctcttactattacagctccaacattgtttgcactgaaaacaaaagttcccatctatgatgaggtgggaaaaaatcccaaatctttcaagttaacagaaatcaacaagggaataaaatgagagataaaagagagcgtgggagagaggagggggggcaggaagaactgggatgggaagatggacaacataccatcacaaaatggttccaaatttaataaaaataggaaaataagaaccgaggtctggaggggtgggcagggctaccgatgcacttggtgaatgtgcttgcacagcgtccgcggggcggcaggcagcaggcccctatgtgcgtaccgcttggtccactgtctggccatccggtcatgctctgctctgttggtcatgtactgtgtggcgatgctgcccaccagagggtcagcagggttgcaatctgtaagaagtgagcagatggagaggagaactttagaaa

SEQ ID NO: 2596 - DNA, 1212 bp, Homo sapiens
gcagggcactggcagttgaggttgtctgtttattggtgaggaaactcctcgagagttaatacagtgtaatcttttcccagaggtgtgtagagggaagggggcctagaggcatcccagagatagcttatagcaacagtgctttgaccaagagctgctgggcacatttcctgcagaaaaggtggcggtccccatcactcctcctctcccatagccatcccagaggggtgagtagccatcaggccttcggtgggagggagtcagggaaagaacagacaacagagcagacagaccagtgatgaccatgggcgggagcgagcctcttccctggaccggggtggcagaggaaagcctaagtgaggggtcagactataaacgttaaggaaccgagatgagcacctgcttcaagtgcacccttcctacctgacaaccagggaccagaactgcagcctggggacagcactgggagcagctaacagagcactcacctgccccagcatggccgtcgcagccctggtcctggcaagggaggctccctgtggagtaaggggagacgagggaagccgctcctggaactgtgagggagagagggatggatttgcccgtcaggcccattcacgtctgacagtacaggccactcagtcataaactcaaacttaactgaagacttcagaaacagagttcctgagtgagggaaactgagatccaagggcgcctgcacaggacaggaagacagagactcagagccagggatggggcaggaagaagccagtgtgcccagcgccacttgctggcctgcctggaagagcagaaccctggaggcggagacccagcccagagctcatggcaggggctgggcagggtgaggggcggaagtgctcagcaggcgcccctccctggaccctgggaccctatttgccccttgggtccgtcacagcatccgcagtcatcagaatcaggttgggcagggctgaatcaccgctgcctggggctcggagaagaaacaagagattctttggcccagagcagtcagaggtccctgaggaggaagaggccatcacccagaggatccctccccttagtcatcttcctcctgactgatctgaggggagcagggcgcccccttcaaacagagcacagcccaggagctgctccaggagggggcagtccccaactggcttctcgtgctgttagctcttgtctctgggggacttg

SEQ ID NO: 2597 - DNA, 824 bp, Homo sapiens
cttcaagaccagattagtattttatttttcccttcctaacactcaaattcatggcaggtgaaaagataatagaacataatcaaactaacatataaacacaattcaaaaacgtttaaccatctattatagctctttgttgtaaaacacacaaagttaaacagaaacatctttatataaattatccttaataatctgtatacactgtaaaacaattgaaaattcacaccaagatcctagtgcaagcagtggtgtacaaaagtgcaaacaaggttagtgattaacaacttaccatcaatataccacttcaacatactttacattcagccaaatactgaaggtttcaccatggaaaaacacttttatcacttttaaagtaacttgactatgttcaccctgagtgctcttgcctcagtatggcaactgattatgagttcaggttaagagcaacaccagggaatacagaaacccacgttaagttggccattctgacatgaatctatacttgaaaatgaaaacaatcccaaagaaaacctgtatgtcaaaaacagaactgttcctgcctttcaccccaaaatatttaaaactaaatctaagccacttttaaaatgcatgctggccgggcgcagtggttcacgcctataatctagcactttgggaggctgaggcaggtggatcacgtgaggtcagaagttcgacaagcctggacaacatggtgaaaccctgtctctactaacaatacaaatattagccagctgtggtgcgcacgcctgtaatccaagctacttggaaggttggtgaggcacgagaatcgcttgaacctggga

SEQ ID NO: 2598 - DNA, 788 bp, Homo sapiens
gtgatcaaagatgtttatttaaatgcagattttacaacctcaacttgtccctttacaacaggtcttcccagagcttttaatgtgcagacaggcatgtgaacctctgataaagagagggaaaatggagaggcatcttcctctgacttaatacaaccctttttacttttggtagaaaatcataaggcatgagtgtttaaggagcacactttgggaaatgtggttctactagccttactaggcaaatatgcttctaatatgtataactaacacatgtaaagcactaattatattaataatgccatgagtccttttttctttttctgtctacttctatgatagtttaataccatgctttcttttattatcactaaaaagatggacatgttgaattattttataattttcttttacagttctgtgagttaagctgtatatagcatatgggtgtatcattctttagtaaattacatctacttgtgaactaaacattgatttcattttgactttgtgccattgtctaactttgcaaaaaatcaaaatcaaggaatcaaggtgcttcacaaaaggaacatctatttttttaaaaaaatccattctggtcttggtgttcagtgaactttttttcaccaagctaaagcaaaaacaaacaaaacccccaaataccagacatagaaatggagacctcccttcttcctcaggctagattcctgttagattccaaagaaaattgtgctggaactcagaattttcctggcggctctgcatctccttgctatgcatagtatttc

SEQ ID NO: 2599 - DNA, 940 bp, Homo sapiens
atgtataaacaggtaccagttttgattttatttaatcatttcatacattaacatacatgacacatcaaaatgagaaatgcacagtttaaccgttcaacagctggccttacttcaaaagaacactatattcatattaaacatttacagtctttccatctaactttacacatgtcctaaatcattttccagcacttctcacatagaagtctagttttgctctttaaaatcaccatctgtatcacccctagtagacgcgagggtttccccaattacatgctgaagagagccagccaccaccccacctaaagacatccaagcagctccagagcctgcctccgaggccaccccttcgccacggcagtctcgattccaagaactgattatctgacactagtgaaccagcactaaaggctgtaggatgtgactacatcacagttccagaaggaaggggaccatggccaagagaagccctaaatgacagaagctcattaaaaccaagtgccccaaacctcctgaaacatcgttagcaaggagctactgctttcctttcttaaacatgttttgggcatgaccacactctggaagtggtgaactgttacacatttggtgtgtgtgtacataacatcaaaaactactgtgtgaaacttgagaatgtctgattaaagatttcaatgtatatctaaaaactaactcaaatcgttgaccagcactttcccagtatcataacaatgcggctgaccctcttctgccttcactttacaccccatcatagcacattatttgtgcacaactagtgaggtctgtgcggctcatcatccccataaccaagtcggtctgtgttgagtcatatcattctgtgctggttttagaagtcaccataggaaacatgaagtcacatcctggtcaaaaaactgtccatttctcaaaaacagagaaaaac

SEQ ID NO: 2600 - DNA, 788 bp, Homo sapiens
caagttagaacaaacattttattattaaaataaacttttgtataaaagcattacagatcaaaagctgtatttacacttatcgattcaaggtccaattatgcatcaaacattgaatggcacagcaatggtttacatatgcaagtaaattggacatacaaacacttagattccacctctaccaaataccttgattaatgcaaagaggagggggaatactgacacaggaaacctgcccagaaactagactggcagagatgtcaggttaacaaactgctaaaagttacatctccaaaaaggcacttatcattgttataaaagtgcttaaaatctaaacttgaaccttgtgcctggtttataaatttacaagaaactgcaaagaaccacagactagtttttaatatcaagtttccatacaaaattgtccaagaatttatttgcaataccttacatgtgaactgaaataaactttgcaaactacaattatactaaagttttatactgaaaattcaaatcagcttactcataatctccagatagctcttccatcattattttaattaagtattacattgcccaccaacctttgaattatgatcgtgtaagctggacgcaccacttacccttcgggcagaagaaattaggagaaattaagtctcaactgtgacaacaacttgtaacataagcgcaatacatgggattgagagacatcaatctgcaataattacctaatttttccacatggttttaagacttttgtgccttgattctattaaaaatttcaactagta

SEQ ID NO: 2601 - DNA, 1505 bp, Homo sapiens
ttttatatatacaacaaatttttaattatgtactgaaaataaattacaggaaataactttaaaatgcaacagaggacaaagtcacaataaacattcccattgaattcccttggtgggcggggggggggtgagattgcagtgctcaagataaatatcacaaatatatcaaaaacttcaaattgtctatgcattcacacactgacatgagccacaaacattcctttcacagggacagtacttatttagcctaccacaggaccagattttgccataaactacaaaacttttaatacaaaatcgtatttatatatttataagtcatatacatgccctatctgtgattttagaaaataaaagctacacactgtacagacactcttaactcatagctgtaggcaacatttttggatggaatttcttccccaataaaattaatggcatattttatatacatgaaggctaaactgcaaaaagacagttcagtttcccagatatgcatctccttttagggcaagtttataaatttaaaaaggcaagacaaatgtacacctcagaattactttcttagctacaagagttgccatgtaatttctgtgaagtttctgatacatgcattgatgtaatactggtattgaaggcagtaaagcaatatatacttttaatgtagtggctcaataaaggcttcattgtctttccaatctggttcttgaaacagtgattcataaattctctaaaaattaaaatttcaatgggacactgtgttaaagagactctaaatagatttctgaaaatatttccctgaaatatccttttacataagacaaattcactaacattagattaagtaaaaagaaataaaagagttaaacatggcacaaaggtgcatgattaaccaatgctcctcagtccatctgcatgtcttaggagccattaaaagaatgcttaaaactaacaaacaatcttcacactctgtggcagccatctgtgaagccagttacactaaactacttctacagttgattgtaaactttggtttatttttatttgagttctcattgtacagcaagcatgaaaaaaaaagagagtggagtccgtgaggagatgaactgtcagtctgtctttaatctggcatgatgagacacctggtcagtcaggcctgctttgatagagtttgttacagactgccttatgttttcctccatcaaattatcacccaggggcttcaatacctgttcccatagtgtttcagcaatctgatcaatcactgttccaatttctctgaactccccagagtatttaacatatgcccaagtacaaagaaatatcagtgctaaccccatgacaaggttacacaagacagctatagagtttaggccaatgaagccagtcagtcctgagattatatacatagcaaacatgaccgcaaacagtgtggctggggtacgagcagcatagaagatatttttgccatcattgtgctttataaaatttgcataggtttcttc

SEQ ID NO: 2602 - DNA, 1050 bp, Homo sapiens
gagctccaatacatgttttaatctgccttaagtgttttctgtatctagcaagcccaaatcccatccaaacccttgacatgtataggctaacagcctcctatgaccagggctagtggtagaatatataaaattggctcctgggaattagaactagagagcaggggcccacaaatatttcactaaaatgaaatcacccaactcagcacccaacagaaacccacagacccagacatgcacgtgtacaccacaagtcagtagatggagatagcactgtgcactagtctttatgttctcatacagcagctataagcccctgtccctccctgggctccaggctgccagacaagagggccacagtaacgtagaagaagaagagcagctctgtcctcagtcctggagagtctgtgtataagaggagcacgtgaaggtagttacagccgctcaattataatacaggcttaggtaggccacacggttccgatgctttctaaagtctttgtctgtggacagctcagcttttagggttcttttctgtagacatggaacctgagcccagtctggagatccaaatttcattggccaggcaatttttggcggtggcttcttctctgggttgtatgcaccagggctgggatagtaagtgtcctttgggtagttcttaaatcgaggcaccaagacattaaatggagcaaaattttgtttgtgtttttcctgctgaggacttactttctggtacctgcctgcatgaggtgtcatttccttctgtattggcttaaacctcacagctgttctggctcccaaagtatatccttttatactggttgggatcttagataagtcgtatgccaagccatatccatctgaaaaataacacccaggccctctgtggggtgatcccctaagagggacaaacttgttcccaatcaaattcgggggatggaagtgaggaaaaagtttcctctgttgacatgttccaaaagggtagttatccgcagcgtctgctctgctgaagcacatcgcgagctgctagggctagcacttgtgtactgc

SEQ ID NO: 2603 - DNA, 861 bp, Homo sapiens
ggggacacactatttttcgttagtttattacaaaactacagatacaatacacaaaattctaattccgaaatccttctacattttttttttctgagactaaatgccctcaaagcccgtctgcttggcctgtattacaacctgactcctcggctcctggatgcacaggtcagatgttccaacaaccctgaccatggccagtgctatggagtcactccaaaggtggttgagccctctgtgaaaatttaaatggctgctaagtcattctaaataaatagtgaacggattgtttctgcccctaagatgaaatcccacagatcttatgctcaagctcaggtcttcctactgccgccttcgacatctagaaagtatggtgggatcttcactgatttgttaaccctgggagtgccccttgtgatccagatgagtcaaaacaaacggccaggatctcttctaaaaagcccatgatggcccttctggctgtgtctccagttggtgcctggatgctgcccatgtgtttaagggccattctgaccatctggtctctttcctgtgggctgtggggtgctccagtgtcatctccctctgctcctgattttaaaaactgtagaatataggactggaccatattcccactcagttcaagggtttctttcatacaagggaggtccgaggcactggccaagctcaagaggtgaatcagtgcctggcagatttgggtccgtaggctgacacagtacttgaattccaaaaagtctatggtgtcttcactcttctgtaaagcggtgaccaatgcattccagatccgagcatactggtcaacagacccgtactgctctctcttccccgggacggaaagggcag

SEQ ID NO: 2604 - DNA, 1302 bp, Homo sapiens
ttcgaatataaatttgtttttattgaagcagcagtcacatgaccttatatctagcctttagattaggcctgacagagtgagccagccctaaaaaaatgatgtttctttttgcactaagagacataacatgtttacatacatcatccagtattggaaatgagcagactcaaacacaacatgtgttggttacctgggaggtacagccccactgttcgtggtgtccatatattttacagagacccccaaagaccattactaataggatgaaagttaaaagaaaatacagccacaccaaatcatgaacacagtaatcaaagacagcagcttatacacatttaaaaactgtccctttcagagttgttttctttcttttctaagcagtgtctgcaaagcttcctctacatcaaatccaaaggtttccaaggtggaagctgcacctcttggggctacacaatggaataaaatcattggaaagaacaagaagtggtattgatatcttgttctgtataacaaagattaatgtttccctaattagaggaatggaaatggtgatgtgactacatattgcagcggcaaaatagtagggtgaaggaagagggttgggtattgaaataaagaccacacacttgtgaattttaatttcatttccaggctaacctactttttatttaatgcaaattacagtaccagttaactatttccaaaccaagtcacatagaacaaaatgtatttacaagggaatggggaaagggaaaaaaaacattgagcatacttttcacaaaaaagtttatatttaaaatgaaaaaaaaaatcagtcacagaggcattcaagtagtaataatgttatacagattttgcttttcctttatatcaagacagatttgcacaagtgtttgcaatagtttgtatacaacccacagtcctttatatatatatatatatatatatataataaattttgttttttaggtttgtttttaagatggaagtggtcacgctaattggtatgtgtacaggcccaagtgatccatcggcaacacatttataaatgcaaattttacaggcaagcagattttcatacaactatctgtatctgcctgtagacagatatagttaaggaaaaaaaaacttaaaaattaacacaaggaagtctactttgtcaagctaaccccttatgtactggttgtcattttgcttttattgcagaggtgcaaaacggagcaacaaacttgaataaaacggcataacccttgtgaaaataatccaaaccccagggattactttcaaagcctctggaaggta

SEQ ID NO: 2605 - DNA, 1355 bp, Homo sapiens
ctgcctttaggtatggacttgggttggtcctgtcaggaatgatctcagctcactgcacctccaacctcccatgctcaagccatcttcccacctcaacctcccatccattactcactttggttatgaaacactagaaaataatgactgaggcccgacctgacgccaactgaagatgaactgacctcacaaagtgttttcatctctaatatctgtggctatttcttaccaagagagtctcaccctccacacatgggtgagatgacataatggctgatttggtcaaggagcacaaataagacaggccaggcagttactgttcaaacagcaatgtttagttgtacaacacataaagtctagcaacaattacaggaccagtttgagtgtctgtttgcttgttttcaattgggaaatttaactgtaatgtcaccgtaagattggctgggactggtaacatttaagaaacgggttgttcttgcatcccctaggcgtgggcctcttgctccatcaggacttggttgtagatgaatggcccacaagtcaccagcctttgagcaagttgtgtccaggtggagacaggaagagggtgggcaaaggggaattctataaagacacagtgtgtggggcagtggcagtcaacattcgcaaacattcatgcatctgatggggggctttgccctcccttgggtattttccattagcctacagtgaccacctgtggtcaggctaattcattactcacattaatggggaagggggttgggggtaggagtaggtagggtaggtgggaagagatccctcttattgctgagtggacagaagggtgctagtttttccttagcgtgtacatattgtgggtttctgggggtttgtgtgtgtgtttagtttttgtttgtttgtttggacagaagaaagtcaactccagcaatgtcttcttaggaaaaccactcttcctcagtggctgcgttatgaggtggggaggatgtacaaccgcactctgggacagtcacaagtggtgattttttaaaaagtgatcctagcccttgctccccaacatctgtagtgacccaccctcatgaatatctttaagtaatgaaggagacacccttgtcccactttggggctcacacagctgatctcaatgaatctagtaagcagaaaaattgctttcttgaccctttaaggaagccaagagtagctcatgcagatgaatgggtagggagcaatgccattgcccttagagatggttacaagtagctgggatgggcttacaagggcagaaggagctcttgatgagttctttcaccctgcagatgggctaggaccgcgtgacgcagatgatgcagtagggctgtact

SEQ ID NO: 2606 - DNA, 801 bp, Homo sapiens
taaaaatgatgaatattttatttttcagacgtccatattttaaatgtaatagttttataaaagaaaaggttggcaacctgttaaggagatcttcatgtgaaaaatacatgtagaagttttaaaaatttgtggatataattgtcattcagaattaagcaggttgattgctgttatctagatgggtctcttcctttatgtttttcagtcacataatcttgatttccatagttatcacatgtacttaaagaagttaatcaatgcctatatggtccaaggtataatttgcacacagtagtttttggtttttatattgtggatcatatgtatcaaaggtaatattcataaagaacaatgttatagttggctacaaagggacaattccacatttctatacagggaatattttaagggtagagttatatcagctatggtgattgagtttaaatatccctgcagggtcaggaacaaaccagctttcccataagtcgttgtgaacactagggaagtcccaaggtttatgtcttccattccagtggagtaatttagcttcctgcagaaaatgctccgaatatctggcatctggattccagcccaggtgccttatgtgccacagggggttaattgtggaatatttcccatgaaacacaatcagcattggggaggtggccacccctcctcccagggagctgctatagaggttttcctccacattcttttgcatccatttctccaattgcttggtgatgcgctggtgcttccattctgtcatgttggcaacaatcacaccaggattgaaagagc

SEQ ID NO: 2607 - DNA, 1027 bp, Homo sapiens
gtttgtggtcatgattattattacagtttattacaccctctttgacaacaggtatggtctctgcggtctttagcaagagagcacacaaaacagcatgacttaacttttggtattatgagtagatgagaaattactatgaagataaaagttgaaactatataagcatgaaaagtaaaatttacatgaggaggaaaaaattccttaagttgtatgcacatggttaacgctgacttcacagtgtctcaacaatttgccaaaattataaacttgatgtaatccaagactgaagacagttaataaactgttttgaagaaacatgtacagaagtcttgtttgaataaaaaatacatattagtcacatataatcaaacaactgaaaatgaactgaggcattacattgagctacgaataacaggaaacacttgaaatttcctgatagaggaaagtgctcattctcacatcaaagtcctgggtgaggccagtcactgcacactacagcagaagaacaagctcccctctggttggttttgacagcagcatggtagctatcaggctgaatcaagaatacagtcactactagtatgaacaaaggtgcttactacacaaattagaccgtatgccaattccgtctacagactaggggagtcagagcatcacagaatattcccaaccaggacagtctgaattagttgcctagtacagacataataatgtctgaaggaaaaccaaagtgtggatggatattcaatgcagggcttctggagacctgtgtggaagcctatcacctccgagaaaattaaagtcaagtcgttttgaggatactcttgattggcaacccaaagaagcaggaaaatgggatggaagcaagtgtccatacagcctgtattcacacagctgtctccctgtatggtgcttccaaaccatgactaatgccttcttaacttacttccgaatctcatgtaagataggttactggtgaattgtatcatggaatcacaaatggaatggattctgggaaatctagttc

SEQ ID NO: 2608 - DNA, 1223 bp, Homo sapiens
agaacaattcttttatttgaaaactgctggtatgaatttcctccttccctcaattaggccagaaactcatcatggggcatgcacagcatctacaggaggaagccccagcttgtgggggctaggatggagcagccgtgagagacacctagccaaatgtccgtttttccatcataaacaatggagcgggggtcagggggagaagagagtgggtaagtgaatggccagaaactccagagggggcctcacacccacctgtgaggtacctccttgccctacccccactgaggcctcaggccccttgcttgggtcatgctgccccctgtcggctgctgcccctgcctcttcctctgagttctaacaacacagacactggtgcctgaaagccctgctgctgccagggagtcagaattctggctgcctctacttgggaatctcctcccatgtggggatctgcagaacatccagatggggccatcccacctcatgatccattcactcccagtgggatacactggaattcaacccggagactggagcccaacagattaaggcagaattctctttgctctggaggcaggtctgcgggaagggggggaagtctagctgcccctcatgtcccatgccggtgagggtacttggcttcccacagctaagcccaggagcttcctatatcccatctgctgagacagcaaggggtgccgcctggccaggctcctgacatggctccactgaccccctgaaagcccctgcagctcagcctttaagcctccattcatctcggaggtcagatcagccatacgccttcggatgagtgagactgcaggtcactctcacctgtgaaggtgagatccttgaagggaggggcttctggcccatagcacttctgtgctcccaacaaggaggcctgtccctttgacaccctggccaagtacagctccagggtcttgagcagaacccgtgggctcttcttggccaatacttccaactctgcaacagagagaattggggagcagaaggcttgagggggctctgggtgacacaacagtcaaggcctcaagcctagcagctctagggagtacccccaacccctatcccatggagagaaagtgaaggagcctcagatggagagatcaccagagaggtaggctagggagccagctacagccacagggaccacacactctaccttgtctgcacaattgcaactttgaatagtccaacta

SEQ ID NO: 2609 - DNA, 1456 bp, Homo sapiens
taaattacaacttacattaaaggcagattctttattggctgaatgtgctgtagtagatatttaaaatatcacaaacattcatgattgcagtttttaaacttagctcacagttgagttagatacaacagttaacatacttaggaaagacaattcttaacagctttatcaagcacatttgtgaaagattaaactttcatttccagttaccatgatgtccccccatacaccaaatgaaccaacacatttatttattttaaataatggaaactgtacatggctacactgtgctctaaaattacttgcattaatgaggacattaattttagcatttaaaaaaagagatttaaaaataaccatagaaaaacttgaaaaccctgacaagccgactacaaagagaattcctctctgaaaattttcagatgcgacggtatgagggagttgggtgggctgctgactctgagagaagtcccggtgacctgaacctattccagtgaagccagtcagcagtgaatgtggggcaagtgcatgcggctggtctacagctcccattgcctggtgaccaaggagcatcctgaagtttcagagaagagactgtgtgacagcagcattgttccagctactgagcaagatccttcagcaggtaagaagtggcagagacagtcacctgctgaaggagcgggcagggagttggccgtccacgcggagcctggcctttccgttaggggaccctgaagtctgcgaccgccccgccaacacctgagagtgtaacacagtgcccgttacacattcacactccatcacagataacacacagggcctcagggactgcaacacgtgcatgtgtagtgacgcacgacaaattaagagtgagtgagaatgaaagctcatgcttagccctgtgaaaaataaaaatcagatagcaaaacgcaaagttaaatcacagacacctggaccacaaataatctaccccagttgtaatatgtattttaatggagaccataaatttttccaaaaacccgcttgaattagaaaacttaaggccatttatatgaaatgagggttttaagcacagctgtacagtttaggacagtaagagctccaaagatgtctacatagctttccaaatctcgtatcagtcagtctctccgtgtgtcgtgggagctgcctgcgcttccgtgaacgggacactgagaaatgcttcaatatgtgccacgccattccagaaaactccctgcagaagcagctcttcctgcagcactcaaccttctgctgagatgcaaaatatattttaaaatgtattttaaagtcatacaggatctgatctagtaagaatggcaaaacaaatacttcctgggcatttcaaatgaggtcattttggttgaaatgtataccaacaattttcgaagtcagaggaagaaaaaagagaaaaatggcaaacccaatgtttaatacacca

SEQ ID NO: 2610 - DNA, 652 bp, Homo sapiens
aattttaagtaatttatttcaatagaaatatttcagaaaactgtacttaaattcatcttaagttagcttatgcagacacactgaagatcgcacactcacatttgcatattaaaaagaaacaaaaagtgagagaggaaccaagctgcacatcactcaaggaggtcatagtgcaatcgagtgcttcatcattagagtacctcaagttaattgggataaagaataaaaatggcttgtgttttcagatatattatcatcactgggtacctgtccttacagatgtttgatctccttcagattatgttgtgaaccagttccccaccccctccccacacacatgttctttagtaggatgtaaaacaatgaatttgtcaataatcaaggtacagaaactcttgagagtctgacttattatcagctattttaccatacctattaagtcagtaattattggactatatatgtgagtagttctagtaggtcatatcttcaggggaaacaatatttgttatctggtatctaaagcacagctattatttatgaagtttctgcttttctattaagaaaaaaaagagcccaatcccaaaacactgtaattatgtattcttttaatcccataatcacttctgtagtacaaatggccagggtcaaaatt

SEQ ID NO: 2611 - DNA, 483 bp, Homo sapiens
gaggtgtccttatgagtatatttatgtgtcacacacacatgtacacactcaatgctggacgggagggaggttgagacggacaggacaggaggaggcacccaggtggcactggcacaggggaggagaggggacacagcgagtgtgtggccccactttggccccccaccgcctcccaacaggaggtggacctggagctggaagaacaggaaatgcttattctcttagaggacagtttcaaagtgcagaaatttctcttataaaaatcctcttccctccatgctctgccccttgctgaagcccagccccctgcgcaggctgtccgtgaggctggggcaggacaaggtcaaggggaagggcgtaaggccaaagcactggaagggcccagaccacatgggcctaggcatagtggctgccgggcgtcagggggtggtcccctctgtggtccagctggtcctgtaagcgggcaaactccgccagctcgtt

SEQ ID NO: 2612 - DNA, 544 bp, Homo sapiens
catattcctgcaaaattcctaagatttattggagactaggcctcttctctggatccacaaccgtgtccagcccagaatcaggacccccaaacgtgtctgggaccctgtccctttcattctggtctagacaagtccccacacgtggccaaaggacagcacccagactctgcccctgaccagtcaatgtgcagcaaacccacttcagtaggcagaagagtctacccctagggagaaggcgccaggagcaggcaggtgggagggaaagtgttcggcagggcagaaaccctgcctggctgtatccaactgtcactcccactggaggcgctgtgtatgcagggcccggcagtaagcccagctgcctacagccaaggcccagcgacagacatcctccttcggtagcagcagcagcctgtcctcctccagccggctcaggaggcctgccacacccagcatcgcccccccccacatcccataagtgttggccgtgaagacagctacaatgaggatggtcactgcgaccaccaacagcattgcctgaccagcc

SEQ ID NO: 2613 - DNA, 840 bp, Homo sapiens
tgtgaaaaccaaccaggaacatttattaaaaaactaagcaagttatccccaagagggtgaagcaccgctggctggttctgacattcgattcaggctgaaggcacggcaactcctccagcccttgctgggaaatgtcctacccaggccacgggcagtgccccagtgcagctgggtcccctaaaagcccccaaacacatgatcccaccaaaggcttgaacagagcaacttcatcaagcaggcagggaccacacctgagacacaagggcaaggaggtaaagcacaggggaccgggagtgggccagggacacccagcccccgtctccaactggcgccccctccaggggggctaacatgtggcgtggggccaccaggacctgtgcttgcccctggtggcggaagagctaccctccctcttgggtggtggggggatgttgtctgcacacagctcagacgaccgagggtacaggaagaatcaaactcagtcaaccattcttcaacccaactgggagtctgtgaggcctggcacacaggtgctcaataaacacttgtggcatgaagaagtgaaggaaccgatcttgttcatctctgtgccccagcactcggcatgtagcccatgatcgaaaatgcagactgaacaactgtcacactcttttgtatcactagtgcccggcacacagtcagtgctcttcaggtgtgtgggaaagaagccaatgagtgagaagttcccacaccgtctagcagtgaggaaaaaaagaaaaaagtgaaaagtaccttgtttactcccattcccatcccatagctcagctccctgcacacagcaggtgctcagtaagtgtaccg

SEQ ID NO: 2614 - DNA, 1339 bp, Homo sapiens
accaaaatactttctacagaattccaaaccaaaatgtactgtttaaggcatcttttttataacattttctcttcactcaaagatgatagtcatgcagcagtttaatgataaaaatatattaatattttactatacagcagcaagaagttagttgtcaattaaaagcacacaaacatctttaaaggaaaacctgtaaaagactatcgttacaaacaatttcagtttggaggacaccagcttggtaaagtgctctcctaaactttgcattttcataccctacaccttgaatatatgagttatagaacatacttttgatagaaggcttgtacacttggggaacacaaatacacttagcatataatgtagccagtaataactagcaccacagctacatggaaatcctttacatacaccaacttggctttcacttttaaaacaaaactcagaatccatggctcagtaggataactataattgtgttgctctgctttttaacaggtctacataagttaatagcactagcaaaaatcaaagaatagcttcagacctcttacaagtttaggagacagtgctagtgaccacaaatagactcactacctgatgtccaagtacaggttcactggaaattgctgcacgttagttttttaaaatctttctacacataataaaaaaaatatattatgaacgatacaagtacatctcatatacacaataatgacaaaacgcctactcagtcaaagcaaacagatgcagaaaaatattatgggagatctcctttttctttctttttccttttactatttgaataactttggttccaaccataaaaatcacaacttagcaaatttcatttaaatgccttttttaataatttcttcatgttcacagaagtttcactgaccatttttataagtttaaggtccagatgcaatgcatattgtataaaagagagcacttattgtttaccttgcatgaattaaacctacgtacctttaactctacaaacttctgcataacatttagacaaagctcagacacacagcatgcctagccctcatatatatacacatctctaatcacaggtatatagggtgtcaaatatactataataacctccatgtaaggtttgaaatttggtaacaaaatgagaaaaactaaaaatattattttacgtgttctaaaatatctcttttttgtgctaaagtcaaatgttagctcaacatgaaaaggacttttatataattcagcaatattataatcttgaccattttgcaaacactttttaataataatagcttaaacgtgtacaaaagttcttggttaattagggaaataaaca

SEQ ID NO: 2615 - DNA, 507 bp, Homo sapiens
cacttatagccaatatttaataatcccatattaactgatgtgtaaaaaatgtctttatgatctgttaccacccaaaagaatgcatcataactttcaagaatatgttctttgacttctaacctctgctcttctttagaattacctttgctgcggccagtacatgctccttgttaatgactctacatttactcgcacaagcgtttgtcctggactcttctgctaatcgatgaacaaacagtaaacagttcagatggaccaataagtcaccacttttctccagacgaagttgaggcttctttcgcttgaagactcgctttagaaagccacggggagccttccgctttatctgcttcctctgggagactatggtcgacagcgccatcctctctgtcaagtaccagctgcctcagcttccgaggtgctctctgtatcgcacacaagctccggggacactgggccagcgaaaacaatccggtccgtatgacgcttcttcaggcagaaaaacct

SEQ ID NO: 2616 - DNA, 630 bp, Homo sapiens
tcaaaacatcagactttactgattaaaaactcagattctcactaaaacacacacatgaaaatatctgaacaagacaaagaagagaaccctcttacaaaatcacaaataaatggtggatagcatgtctgttatgtgtcctccattgacctcctttcctatgtccattatctattcatgaatccttccatccatgaggtacttttttttttgtaaatgacaatcccccttcatacactcttgcagcagacattctttcctatctacatccccagttgtttcatatatgaacttcaatcctgacccctgcccatgaatgaacagaacacccatttcaagaaattgggggttttcaagaatatatcattcactttgacaggagagagaaatacaaacagtgagacatgtccagaggccaaattagaaaaccacctgtgattagttgctgaattctgagtcctcagattctccacatctatcaagtggtttccctaaacttaatctcatgtttcccaagacattagtattcttcaaggttttctttctgaagattcttttagaatgacatggaaaaatattggagaatctgcacatttataagcacaagtataggtaacctttataaattatctg

SEQ ID NO: 2617 - DNA, 907 bp, Homo sapiens
gtattttccttcactttaatttttattgcttctccagttcagataattcagcgcttcctctttcttcttcctcaccttgttcatggctggctgttccatcagcagaacttccagcgattgccacattcattgcataagacaaaggtagtcatgggctcatcagcactgcgtgtctgcacctggttataggtgcagttcttcttcttgcatttgctgcactggaagaggtcagtggtggtgccgccagtcttggccatctggtgctcacggatggcctcctgggtcatggcattcctcaactccctcagttcatcactggccatttcctctgccgtcatcttggctataagccctgcggagatggccccactgagcacgttccgccgcaggccggggttcctggggtccttgaggttgcttatgcggctgcgcacgcggttccggtacttcatgtccgtgctcttgagctcttggtagatatgatcttcgatttctgatgccatcttgtcacagttgactccatagtccttgtaatcatcgtccgccttcagggctgctgacagcatctccacacacttgtcccggacagagtcccctgtgagatagcagggggccaggagacacatggaagaggcaaacgtgggggtcaaggggctgctaggtgttttggggctctccgcttttgatttgctgctgtttgatctttccaccgatggtctttttggagaggaggaggcagaagacttggagtccacagagtctctcctggttttggggtcttctcgtttttttccttggtggagaaaggcctgcttctggcttccagtctgaacactcaagccctttttccttcttctttgccttttctctttcctctcctttttctccttttgggggtccaggggag

SEQ ID NO: 2618 - DNA, 1098 bp, Homo sapiens
actttacgcatttttaataacaatggtacccaattcattaacaaatgaatttaggcaatgtgctttgctctacaatccatcagatacattttcactgcagatagttcagaaatcattttggaaatagacacaaacatgtacatattcatttgctgaaaatgccacttacagctttaatatcaaatatagttatcatagttcacagaaaaagtataaagtgcaaaagctccacttcaaaaggccttaagtcactcccaaagcaatgaggattaaattttaccacagccagtgggcatgccacccttatgtaggacacctacataaggtataaaacaaggtatatatctgaaaacactatattgctctgattacatattgtggttataaaatagttttaaatctggtttaacatacagagaaagatacaattcaaacaattagtcctataaagtaggggttatttatttttttaagtttgcaggggaattatgtctataaaatccattgagaatcccaatctggcccaagacttctctttggccagctggaataatagcacctaggcaaagccttggctatgaaagctttcagattaatttcagtgtaaaaggagctaggagaggggccctgactgggtgagcttcagcatccacctggtccctcagagatggttccatgtctgccccaagggataaagagccaggaaggctcaaatcccagtcctgagggctcatggaagcatgatgaactggcgagagaagttttacacacctgacagatccagtaagtggaataggtggtcgtatttttacaaagccttgtgtttgatgaccatcaagctttgtccctcaacagaacatctttgatctataattaatgttttaggcactcttcactggacaggcatagagttccccaaaaatgcagcccatccccaaatggattcagacatctcatctccacacaccttaaatgtgttcatggaaggacttgatttataatgatgtaatcataaagggaagaaaatattactttttctaataatcaacaactaaacactgtaaaacatgaatcgctgactgaaatgatcactcggaa

SEQ ID NO: 2619 - DNA, 801 bp, Homo sapiens
atctttaacaaaggtgtgtttatttccatatattgctcattacatttttcttgccacagttttatctaaagccaggtcaaaatctttctctaaggtatttattaatagtgtatgttcttcagatataaaatccctctggtcaacatgcaacatttgaatatctattggcactgtacctctatgagatatttatgacatttgttaatagtgaacctcaacctcctgaccccacatccgaagttgggggcgatgtgggggaacatacacaaaattacaaccacattactggtcaagcactttatagctaaaatctattgactttaaaatagcattgtatgtgaattcagagttttaatgtattttgtggatcaaaaggaaagggtcaaaggctaagctgaacacggagggcactaaattagctaataaggcagctagtgcccctgttcttgccccagccctgtcatatcactacatccgattctctcaaatgttataaagaataatgaacttaaaacttcaggggttcctgaaaactggtattaaattaaaagcagagtagtcaaaattctttgcaaatgacttctgtgatagaaaaaaatatttccaacctgcgtcagaggagaattatcttttaggtgccaaggaaagagtgataaagatgctgagtatattagtcaaggtcatctgagaagactattttgtggttgattcttctgagcccctgaattgtccaacattattggtgtacctgtagcgtgaacaacattgcaaccaataattttttgaatacagcaatgtaaa

SEQ ID NO: 2620 - DNA, 773 bp, Homo sapiens
tgctttccagcttttatgaaaattaataacattaatagctcacagacatatacatacacacacattgctatgtacacagtcattaagttattaattaggctctgtaaaaaaaaaggtttctacattagtgttccgggctaggcccgatcagtccttggcatattcacagtggcagccccagggcttggccccacaggcaggcagaggggaggcaggaggccacagagcagccggccccacagtgagcacagcaagtgtcctgggccacctccttgagtcttcagttcccttcctagcacctgcagtccagctgctcagcaagccggcagacaggtcctgatcccttctgtggccttctgcatggtggcttcgggcaacgtggcgggccctagaggatgctagccagctctgtggagtctgtttctgagcagccagagctgctggcctcgtccctcagtgcctgcagggccttcttattctgccgccgcctctcctcatcaatggggtacattttgaagagcagcaggcccagcaggatgagaactatgggagccatggtcacgagcatgttcagtgtaaacttgacacgttccgctgcgagcagccacgggtctggtaccctgcaaagtccagactgagggtagaaatgcccagtgacactccagaggcaaacttggtgaagaagacatagaaggagaagaagatgggctcggttccatggaagtggggctgcttcagatggaagtcgtcaatgacatcaggcagcatggacc

SEQ ID NO: 2621 - DNA, 668 bp, Homo sapiens
gtgtatgtgtgcctgtgtgctctttcaacaaatttattcaattcacagtgatatctgttggacagagtcagcaatcctaccagacaaaactcatacacacattgattccagatgagaaacaacagtcccccaaggagcttgagaaatcacctagggcagccaagctggggaagggaagtggctgtgcattgctgtgtgtcctttaaggctctttggtcctggttgatttcctcttagaaggttccaaataaaacttccctttcctattcagtacacaccagtctttctttggtgtttaacctaatgggctgaggaagggaggcagccaggaaattatacccattaaagtgtgtggttaatgcctatatatatcatttttactcacagttagtggacttatcttttaaaacagaggtatgtggcagtggggtaagagaacttcccttattatagagaagattccaagaataggttcagacatgatttgaagaaccatgtaactctgctgccttgcacggtcccctttttagcactaataactcctaagtgtctgataatttcaaggttagcagcactcccaaagaagctgtccgggctgggtgtggtggctcatgcctgtaatcccagcaatttcagaggctgaggcgggcggatcacctgaggtcagg

SEQ ID NO: 2622 - DNA, 1760 bp, Homo sapiens
ttgttgttggaaaaacatttattgcaattcagtgtcaaaagttttttacaaaaatatgccaccgtctggtacaaacaactataaaaaatcagttcatcatgcaagaaaagtgtgcaaataatttatacagaaggactcagctcacacaatattaaataaacatctctgcatgtaattggtctaactttatgctttagttacaatgttcaaccccctctaatacttttcatttaaaaaagtacattaaagcttctaagcttaggacacaggctgtaatatacgcccactttagccatggtgattggcacttggtagaataaagatggcaccaaggattcccaagtatagaatacagcttggagccttctgcttaacagacttgtgcttcgttaattaaacaaacacatctatactcaaagacagaaaaagtcatgtttaaactccagaaataatgtagcagatggagttttaagaagttcagagttttggagcagccatcatttttggccaaatggagcagggcctaagttttgagagattctccagaaagctttgtttgctgagtgaattcaaggacactttgaaaaatgcccagcagacaaagtcatgaatatcatggccccttgctcctggctgcctcatggaataatccccctttgcttagtaaaagatgaagtttagtggagaatgaacatccgctgggctagaaatgcactgaatctcatagctggtcctgaaggaggaaatggagaagatggattaaatgtacctctgagtctaggggagaggaaacacctgcttcggaatctcagtttctagggagcaagccactgcccagcccttctgtctttttttataacggccatttttgtaataaaaatgtaagtacccaaggaagaaataaaattgtcaaaatatgctgctttctttatagcaagcaggttgtactcactggaatgccacattcacaacagaatcagaggtctgtgaaaacattaagtggctccttaacttctccagtaagaatcagggacttgaaatggaaacgttaacagccacatgcccaatgctgggcagtctcccatgccttccacagtgaagggcttgagaaaaatcacatccaatgtcatgtgtttccagccacaccaaaaggtgcttggggtggagggctgggggcatagaaggtcaggcctcaggaggcctcaagttcgcattcagctttgccactgtaccaggtgggctgacgcacatcccctaaacattctggatctcttactcatcgtgaaaggcagacgctctaagtctaaagtctagggtaggagtttccattctttggaaaaccaaagatggttactcttcttaatgaaactgagaagaaggtatctacagaaaacactgaatttaaacaaattatgaccttgtttgttgaagccatcaaggacccaagatatatcaaagaacaacatctctgtattggcctacaggttcagagtgttttgaggtctgtttaagcactaataggattttaggccagcatccagtcagaagagatagttcacagactcagagttggaaacagattaaaaaaaaaaaaaagatgtcaacatagaaaatgatgatagagtttagttaaaaaaattcacacataaaattacagttaaaaaaattcacacataaaatagagtgtttgcatagcaagacattattgcccttcagcctggcagaaaaacataaactcaggtgtatattttataataaac

SEQ ID NO: 2623 - DNA, 1214 bp, Homo sapiens
tttcctataaaattttatttattacataaaaaattctatacatttgttagactaaaatacagttttcattataattctggcaactgagtcagtacacagagaaaacttagcattagatcagcacttttctttctagttcgtatttctgcacaagaaaaacatttcaaagctccgtttcatataggctgattgttctctgaagccagatggaattccatccaattcagagctcttggaagttaatttcccagcaagatttgataactccaactccagaaagttaattgcttaatatacatatttttaaagtcctctgagagcataatgctccatctgcaaagtctgcactgtgtcaataatgaccgtcacaaatactagggctacaactgtgtctgtggggcatgttcaagcacctacatgtttgttcccccacatgaatacagtgtagtgacactgtaataagaaaaaaatccaaaataatggtaaggtaaatgattccaaactatgaattcatggaaggcttaactgtgatcctccagtttataatggacaaagacaagacaagatacaaaaattcattttggcactatgaaataggatgcaaatggcaaaaaaaaaaaaagacaaaaaggcatcagattgagaaatatgtggcaccaaaacatacttctcatgccacattacacagctgcgagaaatcaagacacaccgatgtgtgttttctgctcatatcaccccatatgctgggctgggcttgacactggatgtgaagactcagtgcctgagagatcaatagcaggtccctactgtattgactgatctttaaatttggccgccttattattctaggagctctattctaaactcaaggagttcagaaagctgtgccagccagtaagtaaagttggacctttggtcttcagaagatagggttttgtctttggttgttttttgaagcccctgtcattttgcttgatgcccttcacacttttctccctgcctttttgttaaagtttttttctcctgtaataaaatcagttaataaccactgaactaacttctttagattaaagctctattagaagtgcattcagtggtccagaatattctgagaaagtataacaacttctttcattatggagctctcagtatctttttatagggaagaagtcagaaaactccaacaacacaacacaatctagtagcattaaggc

SEQ ID NO: 2624 - DNA, 824 bp, Homo sapiens
aagttctcagcacccattgtaatttatttgtgaatgaatgggaaaagggtatcagtccaaggggagatcaggtggttcctcctcatcagagtcaaactcaacattttcatcttttacccatcgacctcgtccatctgggatccatccagagcttcgaagggtgagataatggtccagggctcgtcttcttgtggggctcatgggtgcaggggctgagacagttgctgactcctcggcctgtgggccagccgcaggttcaggttccctactgatcttcccactttggagtttgacctctgagggtggcataggggaaagggagacagagggaccaggggcttctggtctgtacttccggcggcagcaactgttatagtggggagctctgtgcagagcactctgggtgataagtcgtgtctgagttagcagaggagcctcagctttggtttcttcccttctcaattcattctgatgttttggattctgctttctttcctttcccggctgcttcttgccatagaaaagctgcaagctggacagatgtttcttgcctgcacggtgggcagtcagcatggccagggtgtccagtaccggtcgatgggggcagatggcacaagcaaagcgtccatcccgaagcatcagcgcctcatcctctggaatgtaactggctaggaggtccccgactcttctttttttgagcacattgagttgactccaatcgtctccttccctcttgaaagacatcacgactgtgagtcccagaagtgataaattctctgttccggtttcgccactcctccaggccaccgtagcaagagcgggac

SEQ ID NO: 2625 - DNA, 844 bp, Homo sapiens
tcaaaataaaaaatgcaatttttatttgttgaacataatttgaaactgtaaaaagatttctctgtccatcaccagaaatccagaagacacctgaagaggactgactgtttctttgccacggggaaggtgtgatgaaacaattaaaatcccatgcatccctggcccttcctccacgttgcccctcagaatgcctgcagctgcagcaggcaggaggcagcaggagaacccgggctgtggaaggcccctctgcctctctgggaaagctgctggggaagccagaggtcacagtgcattggaggcctggctttcagccactggccaggccaaaatgaaacatctgctcaagtctccccaggcaccttgctgggggtgagtgggagaaagaagtggagaaaactgatgctggaccacaagttatcaccctgtaccttggctttgaagtggcccctgctggtacaggagcagggtgagagtaaaagtaaataaataaaagcaacatgcttcaaggagagagggtgacagacccactgaagcaccccgtgtcctggctcgaccagggataagccagggcgtgatgatttaaaacactctgatctgaggccaatggcatcaaaatacaaattgctgaagtgggagaggaagtgaagggctgtttgttagggggactacagtggagattctggtgagtgtgggtgggctcgccagtgaccccaatattttctttgtgtaacaaccagagtaagcattaggatgcccaggctgccctctactggcagtttctgggaaggaccacaacagcagcacccaacctgcaacccacaacagccgagacaggagagagaga

SEQ ID NO: 2626 - DNA, 1440 bp, Homo sapiens
gccaataaaatattgcaacctttatttaaaacagaacacaacttggcaaaccttgtgagaagacagagaaagcagtccctttcaagggcctcatttatttacatcaagtttaacactgttagcagttcacagtcagacaacagacggagagaattaaattagaaaaacaactgaaaatatattacaataacaattaagaacaaatacctgacaacactggtaatgtgacacacaattgatgtgtttttagttaaatcccacattgtctcactatgtccccttagcaatgcacacagtgcccgatgctccaaacctcaccctctgtgcaccacatacacacctgcggggcgggacctttggtataaacgttcaacgagttttaaggaattgaatccgcatgtttggggacaaagttctgtcaaccaccatgaaatgtttaaacttatttttactaagcgagcataaaactggggtttgtccagtgacagtcattagagaatcagactgcagagaaggaaaagtgcagggtctgggaggagatggaggttctgagtatacatcaacagctaagtcagcctgttcacagtcaacacaccaaccacgccactgctgttcatccaaggaaagatctgagcgattcctcttttacttactccccctttcttaatgggcacgacagcaatgcacgtgtatttatggacacaaacacacaccagctatacagatctgagatgagagggttttcaaacatatgccctaaagaaccataaacaagtatctcattgttcctttctagtttctgaatactgattgacaattggcctaatcatggtgatttctcaagatctcaagaaattcctctcaaaacataatggagccaaatggccacagtgagaaattgctgtcaaaatggaggagagctggtttctctggccctcatctaccagaagcatctctgtcccctggcgttcttgccactcacaatacctggtatggtacttctgaactgtgcagaacagtatctgaggtttactgttgatgacactaaagcgttcccagtcctgcaaaaccttctgaaacaacaataaatttgcatattctttttattgtgtcataattgctgaaaattaagtatacatatatgtgaaaatttaagtcccattctccaactaaagtttatggtgcctaattccgaagcaaatttaagcaagttctgactacacaaactccttatgtttcctttcataaagcctgctagcattcgacagtttgcctccagcttttctaaaaggttacttagcatgctcggagacctcagcttctgagggttcagctcagtagcctggagtgacaggtaggaccctgaaaatttgctgatgcgagtacagtgatgaacaaagaaccttccagaatagacacagatgacatgtatcacaattc

SEQ ID NO: 2627 - DNA, 1491 bp, Homo sapiens
cgcgctcagttactggagagctggccgcgcgccgccgcctcccgcacgcttgcacgcgggcccggcttcggggttttgggttcttactccaagcggcggggaggagggggagccccggacacactgtggggaggaggaggaagaagaggaggagggaggaagaaaaaagacgaggaggacaggggcggggggcgggaggcttgcaccttcagcccccccgcgaacgcccaaggtgcacacatcttgaccaactcagcagcaaggtggattttctttgtgtttaaagaaaaaaaatgtccctgtgtctgtagagatgatttgcagttcagcccggctgaagctgaccgaatgagactatgggctgtgcctccgccaagcatgttgccactgttcaaaatgaagaggaagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttcccttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcccaatcattttgaatccctcttcctcccttttttttttaagaaaataaacattttactgtttttatgg

SEQ ID NO: 2628 - DNA, 1096 bp, Homo sapiens
gtagttgctgaaaagaagtttattgctattttcttattttattatacaaaactagatttgcttaaaacatttcccagtctctttaaaggaatgctagttagtgggaggccacagctagtaaattaccctcagtagtggtttcaagtagtccataactataaaaatcgttacggccaggatatgccggaacagaacactccccactggggtcctcagccttggatgtcagctcggcccctcaaggggtccctacacctggaagctgattccactcatcagtctcgagctgggcgcatgtggagttgatgtggagttgtagctgactggctggtggggtcagcctggcctcccagtgtggagcatgggcaccagcctcactgcgtggtcaccctagggcatatgctgcgggctgttgtggcattcctgtggccagcccagaggcaggcaggggctgtctggggtttgccatgtgcaccatcacctgggcttggggtgagctggaggagccactgaggcttagagctctggggatcccagggtccttgtccacgctgcgggtcacactggccagcttgctggtgctctcaccatggtctgtggtgaagctgtggttgtcgtgcgcctggctgggcccgctcacgggtttgttgaagtgcttgaggccaaggtatgcggcctgcaccgtctccaagtcctcatctttcagctgggaccacagctgggctgacctgttggagcgccgccgcttgctcttcttcacgcacttgaggaggcagcaggtgaggaaggccatggacatgagcaggatgatggcacagctcacaatggaggcgatcacggccaccttgaagccaaaggtctcgtgtggtggcaccagtttgcacactggggaccctgaagaccactcagcgatgctccccttccaggtgcaggtgaggagcccagaccccaccatctggtggttggaggggcagcggaacatgagcacggtccccacggaagcaccattgccacgaaggacttggaaggttgcttgcgggggtagccgcagcttagcgcaggtgcctgtgcggttccctggggcaggcgtggtgac

SEQ ID NO: 2629 - DNA, 2121 bp, Homo sapiens
ttgctcaggtaataatttattaagtcaatttaaactaaacattactaccattgcaaaagcatttgctctgaaaagggactgaaaaatgcatcataaagttacatagttcagcaacaatatcaatattgattatataaagtaaaactactggcaaacgtcatttaagcttaccctgtaatttttaataactttataaggagcaaatgtgtcaccttaaaaatgtaccagtggcatttacaaattccttcaaactcatttacaaatacagtaataaaaattcctgagctcccttttcttacaccagtattcaccaatcaacatccatgcggtgttttatttgacccacatcctctttccttttcttaagaaaatattttatcacattcgtaaaagtatctgtgcttcaagtcagtttgtaagtatctgtttttaatgtgaacctgatgataacaagagaaaaatgcttaacattagcaggggcagcaggaattgaggggtggtgtgggggacagtggaggagatgtaaatacaagaattccagtttaggtgttgggacttccaaggtagaatacatctgacaatatcaaaaacagactcagtttcatctgcatagtttcgagggactttcaaaggtgaagccagcaggaattactctgcatattctggccaggaaggtccctggtgggggcttttcaataattctatttcttatccttctccctagtccccccactgctcccttaccccaagatttcaaagtttctattaaatggaagttgcatcttccagccccaaagaaactggggagatttagaatgtataaaacttgattagcaagttgtaggaaacctgacaaagttaaggtgtcagatgggattctggcaagatgtggcaatatttaatttctgttttctttccggaaagtatattcaatgcttttgaaaaattagctacatattacttctccagctcatcattaattgtatagaacctgtgtctggtgactgagacttcaaattttgcaccttaaaaatataagagggcccaagaattaaaggcagttggcttcaatataagcacaggagagccagcgtttctgtgactgaagccaagttttttagagcatgatactcaagtaagaaagaaatttctcattcttctgtaagacatggaattagagaattaagaggaggcagagaagaacttggaaagcaaaaccacacaccatttcacaattctggaacacggacatgaacagtaagtgaaactttctaggtttagatccattaaaagattatccatttacacttcatctgatggattttgtcagaaaagatgttgttaataatatggataaataataactgttcaaaaggattccccacttaaaaaaatgctttggttcttcctttatttcacaatatttaaataagcttctcttattggatctccttgtatctggttccatctcccctcatttttctcagcctcccatgttatagggatgaggtaaaggagggaaattttgtcttgcaatcataggaagggtggacataaaggggaagaattttttttgtccaacttacataaacaatgtcctgattatagatcttttggtaacaagaaatgtccaaaaaattgcttcagccatgaatgtgttattttgctcatctccatttcaaataaaaaaatagagcaagagtaggtaagggaattaaacatttattaagccaggcactgagctgggtattttcaataatgatgtgaatagaaatataactaacatattatattgggatgtctaagattttgtttggcaggcattggttttggcatgcagtaaaaatgaagatgttatgataatagcagttagtgttatctccaatactattgacaaagatttaactacccatgttgtcccctcaaaataggaggagataaatgaataaaaccatggaaaacagagagcacaatgtgccataagcaaagatttacagaatgaaaaatgcaaaataacaaatcagataactatagtcttctataaatctttaagtctaaaaaaatagacattacaataactacatatagaaatgagtttttaaaatcaaaataagataattt

SEQ ID NO: 2630 - DNA, 1165 bp, Homo sapiens
gcaagtcttttttttttttttaataaaaccaacataacagaatgtagaaatctaaacgaacatttctccctcaaagtagttacatccttagctccaacaaaactactattgttggagacttatttagaactcctgtttgaggaaaggccttaaaaggtggtttatgagccacattagaaaatacccttctaaactttgggctgtttaaaaacagaaaatccatactcagaggatgacaccgagaaaattaaaaaggtgctgcagctctcacggaggttccctaaagacctctagcaagttctgagcaacagcatcaccattggagaaacgtgtagcctcccaggacagccactttccatgggacggcattcatttggatagaaaagttctgctgtctgtttaaaaagaaaaaagaaaaaaaaaaaatcagccacactcctttatagtcacacttgcatttgattaaaaaaaaaaacaacaacaacaacactcacacgtggttcttgtatgaattctaattaagagacattatattcagaattatagcactcatagtgataattttcagaagactataacagcttctttgccacttaaggggtacagagggtgcagctgtttacctgaatgaattcttaaataagtgactactaccactctaattttcctagttgtagctctgttacaggttactgaccgccaagtccatgttccagacattctttgccaacacagattaattacaagagagccacccccaaagtcttagggcgaattgggaaagggccggttaaatgaggaaacaggccattccttggtaaaagtttgtagttttctttcccaatacatcttctttttattgagaacttccatttttatcctgtgttcctcctctgccatctcacactctcgctctatctgctggattttggccacatgcacctcattcatttgtatcagttgcagttgtaagatggacatttgttgatggtgttcttcctcatgcatcttttttaaagcaccttcctgagaggttttgctcctgtagtttttattggctgttattctgacagctgaacacgagggttcaggttgagaggtcccctcacatactggaaaatgtatgaactctttctcatcatcgcacagttctctatttgaaaca

SEQ ID NO: 2631 - DNA, 695 bp, Homo sapiens
tcacctgggtggccgtggcgctgctcgggggcgccttttacgagtgcgcggccaccgggagcgcggccttcgcgcagcgcctgtgcctcggccgcaaccgcagctgcgccgcggagctgccgctggtgccgtgcaaccaggccaaggcgtcggacgtgcaggacctcctgaaggatctgaaggctcagtcgcaggtgttgggctggatcttgatagcagttgttatcatcattcttctgatttttacatctgtcacccgatgcctatctccagttagttttctgcagctgaaattctggaaaatctatttggaacaggagcagcagatccttaaaagtaaagccacagagcatgcaactgaattggcaaaagagaatattaaatgtttctttgagggctcgcatccaaaagaatataacactccaagcatgaaagagtggcagcaaatttcatcactgtatactttcaatccgaagggccagtactacagcatgttgcacaaatatgtcaacagaaaagagaagactcacagtatcaggtctactgaaggagatacggtgattcctgttcttggctttgtagattcatctggtataaacagcactcctgagttatgaccttttgaatgagtagaaaaaaaaattgttttgaattattgctttattaaaaaataaacattggtattttttgagtgc

SEQ ID NO: 2632 - DNA, 1298 bp, Homo sapiens
taactatttaattcactcctttattctgggatgtatattacagataacacaactcacaaatataccatcagacattgaaaactaaggccattctgtgagttatttttaaaacttggtgttttgcacataatgatcttaaaaaaaaatgaattaccaaaaccaagattctcttctaaaatgaaaatttaatgcaggtacaggataactttagggctatatctaatctgaagcttatcaggtagcaaaaccattttcgttttctacagcataaataacagctctaaggcaaccactacctcagcatgaagctcatttctccacgttagagtagtgtttacctgctacagtgaccagtgtttagagaccatttccctttcagtagcaaaaagagactttacctaagaaacacactacatactacagaatccttggaacaagaaacagaaagggagctgtaactaaggcactgaaagcacattatttgtataaagaaatgtaaacaatttaacaccaacaggctccctccgttggagtctttattgtaaatgcacacaggggcatcatagtcagggctagagtttgaagtctgggtgaaacaaatgtttctgcagagttcagagtcttggctgccaatatatttctaacatggtgctgttgaattaactatttcaaagtgactcaagtggaagctggtatttcccttgaatctgagttttaatagcattaacaaacaaggaagaattttataggagtcctaaaattacgggctctttctaacatttatttgagtcttttatcaagttcttctaatgaattttaggattattttggcttatttcatcaaggaagtttggtgtaagaacttgttacctaatgagtgcccctccttgtaagttcatatttcaagttacatggttcatgccataaataaaccacacttgctttaacatcgttcagaatggtacatttaacaattggacatacagcactgtaaacaattcaaagtccattgagcttaccatgaaagaactgaaacgtatgtaggaactgtgtcctgctgcagacaagcagctgctctggctctggtgcggtgcggtgcggtgcggtgcggtgcggtgaggtgaggtgaggtgaggtgggcaggtgtggaagggagaattcctgaggccagtcacaattattgaagctaaattaatttcttcctgacactttagcattaattctaagtagttctaagttctaaaccattaactgtataatttttttaaatcaaagaagaaaaaggctttcacacagat

SEQ ID NO: 2633 - DNA, 976 bp, Homo sapiens
tttcaaccagtttattgtctgactcttctttttagagggcgctatttgcaggagaacagaacgcgaataaggccagagaaagcacacgcttgtcaacaaagcagatatttcaaccggtttattgtatctttacaataataaaaataaattagtcacacacaaaaatagtcatttttgctgaagagaaaacagaccatatttactcacataattcgccttctacctttcacctgcttatgtaataatttaacactgtagaggggacatggaggtgacggagtatttagtgggttccttgctcctggctgtgcagttcacaggccccacaggccttggccccagcatccccagcagggacagtggaagtgtcagagcagtaaatgccaccacttccctctcagcctctccctgtccccgccagccacctgcctcacccacggctctaaccaagcccaccgagcaactgacgctgccagtctaacaacggggacaaagcaaagagaaagggataacagacaccctcccatttccttctccaaatgtctgtggatgaggggaaggcagattagatgaggaaatataatatttaagatgaaaaagtagcaatcaggttcaggtacaatgctacctgaatgagtcgaaaagcagagtaatttatatttgatcttaaacctcagggaactggactgattagcatactaaacaattgtaactatggactgagaaaaagacatcaatcatcgtacagcgacattccaggaggctgggttagtatgatcacatgctttcacacaaatgtggatcgcatatgtaaataaatacctatcaggtccctttaaaattaacacattctaaataatagaactattttggtgtagtgactcattctgcagatagagttcagaatacatatttcctataaacatcttgtatttacagagaacaaaataataagttataacaaagtatatccttc

SEQ ID NO: 2634 - DNA, 488 bp, Homo sapiens
ttaaaaaacaaagaacactttattcccttgacagtttctgtacagcgacaccaggctgtgcaaagcccagtgtcgtcttcactgagcacattccccaggacgcctggtgcagccctcctctgccccaggccccaactagccacccctgtgcccactagcaggccctgtgccttcacagggatgaagccctggcactgagaatgcctgggaggcaccgtttgctggggagcagagggactgacctttggcttctttgtggctggaggtgttccaggcctggtgagggggtcccatactgttctctgctgagccctctgcacactttgggggatcctggctggcggtggtaggtgggccggagactcagttgtccgtcagctggccatgtccccattttatggacaggcagcctgaggcccagaggcggaaggatttctccttgccacagctgcatcacacttgaactgtccagacctccaccgctggcc

SEQ ID NO: 2635 - DNA, 1463 bp, Homo sapiens
aatttccgaatttattaaaatgattaacctcaatactgcaagtgcatgtacaaaatatttgtaaaaaatgtttttaatgaaacgttaaagaacttacctcaaatgctgaaaaagtcctttttcattctttcagtacaaggaatacattgtatctcaaaagtattacaactcagcaaaaacaatttataacagtaatttgaaaatgattgaaaattgaatactttacatatatttctatgatcatctcctaattcttacaatgccaaaatcttaaccaatcattgcataagctcaagctaagagttttattgaatgcaacctcttctaaactggtcaacggtgtgtggctgtcaccattccacacggtgaagttctacagcagatccggaacagttccgaggcccctacctttaccaacggaaattaggtttccctagaaggcatcaacagtggctgctgagtgcttgtgcataccgactcctgagaggcagtgatttactaccaaatgtcactgctttgagacccatgggaaggttggcctccaaagaggaggccatgataaaattaaaacatcaaaaataagttactaaaattcagctgaaaaatgaaaatgggaaatgtgttttgtcactttttaagatcgaaattcccaaaatagctatcgttggtattcaaataaggtttaagatttagtctctgaacctcttcaaaacaccccaaactaaggtgggaatacaagaggtgacccgctgccctccagcacctccagacacagggtctaccttcatcttcctcagtggcaggggttcacatttctatgcagggaccccatgagggctggacgtgctctgcaaagtgctccgggtgcctcggacaggtgctcctgagaggctgtgtgggctgccctacttcactgttgaagacctccagacgcagtgaacgggggtatgggtgggtgtggaagaaggtctaccacatgctttccaaacgcctgaggagttcgactgcaccacaacaaacaaggatgagactatgtaagactgcagaagtagttccttagagaaccaggagaaaacaatctactttctaaaaatgttcatgagtcttaatttctatttggaacctatgggcaatcaacagtcttaaggagcgtcattgaaacaatatccccccaaacctggaaactagtaggaatcaattagtagtaacagtaagcattgagattttctccactggacttttcatgaccttcagattccttttcatatttcaagacatgggctactttcctatagacactatacaaatcccctgaattgatttttacttaggaacactgtatatcagaaagtacaggtacacatttcccagaaataaagagacctactggtgtcaaacacctgttacagatttatattcccaaattctctgtccaatgatttgcaaaataatccagagaaatg

SEQ ID NO: 2636 - DNA, 1124 bp, Homo sapiens
gtggagcaggaggttttattgtaaagaggccgattgtacagagcaaagattgttctgacacggggggctgggtggtgggacccagaggccagagctgggtgaaggatgaggggtggcatcgccccatccaggcagtgggcagggcagggaggactaaacggctgcctcccagttcccttccctgcccctcattactgggtaagagggagccaggctatttccacggatccaggagaatatagcaggagaccctcaccaccccacaccatgccccaaggatacgggaggtgccccagtctggcttttgcagtcggccagctcccagcctcctcgaggagcagcctggccacacctttttcccctggagcctggaacagctggctttgggttaggaggctggaagcacccccttaccctgtccaggcacctcaagggacagcccgtggttccctggtcaaaccccttagggcacagtgacccattttggcttctgcctctggggctgggtagcacaggagtgggtgggcactgaggggccagcactgagccaggtcttaaagagggagtccgagtgttgggggcagtggtctctggtgggggcatagccccagagatggggctcctgtgagtccagcctaggggttgagggggatctgagccagttcacattgtcctggccacaggggtctctagggcatgacactcagggccactctgcctgttccaggccctgatcgtggtaatttaaagctcagaatggtggatgggggaagcctcagggaccaaggccctgccttcccctagactgagcccctcgtcggcttcatcctcacacccgctgtatctcaaacagcttcacgtcggtgtcgtaccagacaggggggtccacattcctcagatagatgacgccccacatgtaggtgcggaaccacatggcagtgcccgagttggcctggtacttgcggatgaggatggggtggggcacgggcagcagcccccaccagggtgccatgctgcaggaaccgcaggatctcagactcatccgtcaggcccttgtcgatgcagatcttctccacctgcggaaccagcacctgcagcagcctcatgatggtctgcagcggcag

SEQ ID NO: 2637 - DNA, 571 bp, Homo sapiens
aagctataaaaaagtaaaaggggccacaagctttattaaaagtaaatgcaacagtaatatgtacagatggcacatggtgccaattttatttgtaaatatagtactccaactcaagtttacaagttacacctttgccacagccttggctaaatcttgaactagtgcagaattcagctgtggtagagtgctgatcttagcatgcttcgatgtggcatacttgttcttgacagtcatgtgctttgtaagtccttgatttaccatgactacattcttagccaggtgctgcataactggaagaagagattcttcagtatatgacaggtaatgttgtagagttggtgtccattcaccattatccagaattttcagtgctaagcaaaaagctcctgctgcaatttgagaaggaggaaagtgcaccatgtcatagtccaacatagttagttccatcaggtatttggctaaagtatgttgctcgacatcaacctctccaatcttagatgctctccgaaggaagtgcaaaggtagaggccgacccagaccaaagtttaaagctcttagaatcttcatttcc

SEQ ID NO: 2638 - DNA, 996 bp, Homo sapiens
ttgcagataatttctttattgaaactatcaggaagttttactatgaaattttacatacatgatggaaagtggaagacatataccaattatattccaggaaaaaatactttaatagtattgttatatagtgtattggctaattccagtggatcctcatctctcactgctgacattatctccaatatttgaattatatggcagggttcatttctgtcttttaagcagtgcccactttcccacttctttttggtaggaaatgcagttcttatatattttgatccagcatgtgtacttttgactccacaccaaggtgcatctgtctcaatcattaatttttcactaggaattgacttcaaaacttccaaattagcttcagttttcagtgagcaaccattaaatcctatataaagatccaagtcaatcaaagcagctgctgcttccttggtaccatcaaatgaatgcaccactccccctacacaccgatctctatttcttttcattatgtccaaaaattcagcatgtgagtttcgacaatgaagaaacattggtaattttgtttgttctgacagttcaaactgtttttcaaaatatttgagttgagtatctttgggacaaaactgcagtcggtcaaaatcaagtccgcattctcctattgccacaactttccctttattgttttcagcaagatttagcaactcctttaagtaaagatcagggttattcttttcaaattcaccacatcttgtaggatgacatccaactgtactgaaaaacataccatttgtttgtgccaaatgcagtgcatctttactgtcttgtagatttccacctgtaatcataaactttttaacaccaatctcgacagctctccctattacatcctgtaagtcatcttgatgcttttgaacccccctataaattcctctgaacatagggtcagtcaagttgataccaatatcgataaacttgaagcgactcatgactgcgcatggagga

SEQ ID NO: 2639 - DNA, 1420 bp, Homo sapiens
ttcactctgcaaccattttactttattactttatgggaaaatttagatatgcaaagcaatgcagataccaaaatatgctttccaagtgtttttggctgagtttgtctctttcagcagttctgaccctaagatacatacttatatggaaaaagctatggataaaaataaataaaatacatcttaatcatcaatatatagacaaaattgaatagaaaaaagtaagaacattataaagcatgaaaatttacataaaattattcctgaatgtgagggttgaaagactctagaggcctgaaatctatttgaaagagaaactttcaagaaaaggaaaaaagcattcctctacttagaatagatatgctatgatctgattctgaagcaatgggattgaactgaatgatatatgaggtttcttccatggcccactgatttagatgatagcagtaaaaaatatattagtgaaaatcatttaatactgtaaaagaataaacagatctggacaggaattccgtaaaaatacatgtagacgttagtctaaatacatttttaagatacaatatattttgactaaactgacaggatatcaacagctcattcacttgacagtcatctgttataaagccattattatataactttaaaatatatttacagacttaaaaattaagataatgcttttatgtacatcagataaaagtttaattagagtgtagagtgccacttcacaggaattaagataatcatgttttaaacaaaatattttgccatgaagatatagataaaatgtacaaacatgtcacatgatacagaaaaacaagaatcatgatcttcacatttacaggaatttaaaaaatcttctctgatggaaatgtgttacaactcaaacttctcttcttgaaagtaatccgcaaaattgagatattcttcaagttgaccatatttctccttaatccagccattttcttttgaccgcctgaaaattctttccactgtttctttaacttgttcatcttcaacttcttctgtcattgcaatggtgcaacattcctggtatagtttgaatttaaaatgtttcagtttatgataaattctggtacggctggcacaaattctgccaacagtgaacacctgtttatcatgtgacatgaaattatctatttgcatggtcctggtgttatacaactctcctgataaatgcactgaatatttacagtagcgatgcagtccacaagcctggcaggaacagttttcaggattcttcaaatgaatacttacattagaataattttctactcgctccttatattgctctttccaacgacttctagataccaagctctctagacgaggctgaacaaagcggttatccaaataatgaagagatgttagcatatcttttgcatatgatttttgccttgtg

SEQ ID NO: 2640 - DNA, 632 bp, Homo sapiens
caatagagaatctggatctattgaaacatgtttaaaacggggttggtcacaacaggatgggcacaaatgggagcgggggaggggagtggggccgcaccagcccctgccagtgcctgaggctgcagcctggcgagtgcttttgcttctgcttctccacgctggtggttcgagatggtcccaagccccactggggcaggccctgccttgccctgcagaggcagggtggctccacttccccatctcctcccccatgggctgcaggggcatttatgatgcccaacaggtggcactgtcgcgctccttcctccctgtctccgtggctcagaaacaggttaagggtagaggtagatggggagacgtgggggccacacagtctccggtggcagtgagggagcttgggaccctgaggggggcatgctgactccttgctggagaaaaggcacctagataggggagctgggcttgggggcctcccagggggtcctggggtgaggtggggagggaggctgaacgaagcaggaagcagggtggtgggcagaccccaatcctggtttccaaaccctcaccggctgcgggagaaggaagaaggaaggagtcctggacagagcctgccctgatcccctacgcctgag

SEQ ID NO: 2641 - DNA, 1237 bp, Homo sapiens
ctaaacaaattttcacattgtaaacaaagcgtcctattttgtatttgagttttgcctttttcttcctagggaactataagagagtttctgtgaccattaagaggactccattttcaccgctgaaatagaattattgcccttatagtcttgctggcaaattgttagaaaaaaagtttatttacagtattttgcttttccataccaattctagtgagaagttcacattcttaaattcccagtcagcaactgcatttctcccctccaatgtcctctccatgacttatctctgaagtttcgagccaatgtttaaaatgtacactatttacaaatgaagtgtccaaatgccatattcccagctctccagtcagcagggggacccttctgaagtgttgtcatgtgctgggattcagaacttgaacaagttgataaagtcctggggtgaaagtgaaacggagcagctctctgggttattggcagtgcacggatggtcagtgcccttccaggaaaggatgtgacagtgtttgcagagctgaagggtatctccatactgctctttccttgggtaacatcggacaagtttgaaatacatcttcttccaatccagctgccctttgtctgacagaattaatcgtttgcggatctgccgctcggagaagtggtactggcagagtttcttccacagcagccggtcttcgctgagcacgtgcaggtcgggggcagctggcccaggctgaccaggtcccgcccgtcgctcagcctctgcatgatgttcagttgtaggcacaaaggcaggtcagtgaaggtgaggcctttgaaggcaggcctggtgatctgaatgttgttcagctgctgctgccagtggagaatcgtctccatccgatacacccacatgttaatgttcccgaccagcacagacttgccgactctttagaccagtgtacataaggatgtgtagagggtctggagtagttcccttattagtctaatgttttgctggtcttcaaggactttcagtaccactttttccaaaatattcatgaagttcttttggcgatgccactcagggatgtgagctgtgactttgctatcagctccaacagccggaccacgtagttaaatcttctggaatccagaatggcagttgagaagtccagtctgttgaaagcttcccccagggtgcaatatccatggcgctctttagtacttcctttgtgaacatagatccatttttcttggt

SEQ ID NO: 2642 - DNA, 1012 bp, Homo sapiens
ttcaaaacagtttattttattttattttttttttttgtcagacaaacacattgatttctggaccacagtagaggatggaaacctttcacaaacttatttatttgaaaatacaaatataaaattatactttccacatctgtgatgtgagagactgccatccacatagtaattttttacaacagggctttaagaaagccacacacaaagacctgaaagatgcttgagatatatatatagatagatacatatatatgtatatatataaaaaaaatactcactaccaaagttctcatcagtttcatactaaagtataaaagtaagggtgaggtcagccacagtgctagggaaagttttatttagatacatttatgtccacatgaaacgcttagacttgcatcctattacatatggaattcggagtttacaatacaccatgaacggcagattggctagcccacgctacttaagaggacactcacagattccacatgggatggtacattatgtacagaatacagtagtagagaaccttcgagggaggctctggaacttttgtctctcagcctccggccccctcccccatcatgcccctgcctcccggaactgaaatcctgtctgagacaatacattctgattatttgatagccaggtgtttggattaaggttgcccccctgcaggtccccgacaagagggatggattttatttatatgtttttgtgttttagtttacttacttttttttggtagaaaaaaaagaaagaaaaagaaaacaaacatattacagtattaaagtattgcttaacttccagcgtctccttgtgtagtgtctgtgcccaggacggggctgagctgacgtctgctagttttctgctttggggtgagggtggggaaacccgccagtgtctttcttcaatgtgcttgcctgcagtcagtccctctgctctcccactgtctgccttccttggaagatagcctggcttgcgaagcacattcaagaaaaaaaaaaaaaaa

SEQ ID NO: 2643 - DNA, 706 bp, Homo sapiens
caagaaaaaaaaatcactttaattgaggaacactttcagtttgtgacaaaattatgctgtgaatcaggtgttgcaaattatggcccactgcctgcttttgtgtaagttttattggaacacagctacattcagtccatggctgcttttagaatacaacagtagactttaacatttggaacagggaacagaaaccagagccatacagctaataaacttgaaaatatttacaagttgatgctttacaaaatccatctgctgacccctgctctgtaccattgttctcttctgatggtctgtttactaaaaaataaaaacttcacaaacatgtaaaaaatagatttgccatttaaaatgtgcttttcaagtttgactttttaggatgcaattaattcactaaatacagaacttaactaaggacaaaaatttaaagatcagcattctttcccttcccatcacgctcaacttaacatgaagaactgtaaacatcctaagcttacaacaaacctatctagttagacttcagttaaccacttacacatccccctcccccatgaactatttggaaaaagctgcaggcgtaatattggatccctaaatactttattctccttataccattatcagacccaagtatcatctaatagtccataatcaaactgcctaaacagtttctacactgtctttttaactatttcaaactatcaag

SEQ ID NO: 2644 - DNA, 1125 bp, Homo sapiens
cctgagaagtcactggtgtttaatggaaaggtatcctattagtccttggttaagataaggcagtaagagtatcactaatactatgtttttgcttagaatgaggctgatccttccactggcgtcttcacgggcaattagttccctctcttttgctcctagaaacacaggtaggagctgtctgccccctattgctgttgcattttctgagtgtgttgaaggctcatctagtctcatcacagcagcttccccagtggggatggagcgctgtatattgcattgtagcatctctccaggaagtgcacgggccccacagaggaaaacacaggcatctttctttctgactcctcttctgtttctcttagggacggggcccataaatgattccttcacatgatcaatcagaatgcgagacactgttgactaaaacataaagcaagtagccctgatttcagagaaatggagttacaaataacattttcaacagtgccttaacttgcaaggtagcttttactgcagaaggatatcagctccttttgtctacctatcagaagagaaacaaaccatttccgtcgaactagaaatgcttagctcttatgagaatattgtgcttttaaaaaaaattcaaatgttaacattatttgcagtctgtgttctaaggtttcaatttgttttttctctagtccatttgatcattgtctctggtgagcgatataggaatattaatttggcatagagatcttcttctagctccagttctcctgtctctcgaactaaaaaaatatctgtgcacaacttcaaaattcgatccacatttggaagctcttcaaacatgatggagtgagaaatcccactgaagaattcacggacaaatttcccaatcacaaggacaactgaagcatataatcccataataccatagccagccaggaaccccagacttgggggactgactttgtcattgaagaccaccagttccagggcctgagagttcggattgtatattctgtttccagtcaggttgagaacccaccactcactgttatatttagttgtattgtctctggacaaaatgatggtaatatccatgaaattattttcagataaaagttgctttataggttttga

SEQ ID NO: 2645 - DNA, 1279 bp, Homo sapiens
aggtttcaagtaagtgacttttatttttctctgacatttcacagtcaatttctgcaaaacttcatactttctcaaaagaattcacatttgctaaataaatttctaccctaaagaattcatagctgaaaaaccacttcaatatatgcacaaaagttacttttctgctaaaggaaccatagtagaaaataaaaagtcagacaatactataatcaataaaaaccaatgagtgtaataaattacaaatgtcattaaattccattcccataaccattgcaatcagcaacttttctatatatatttcaataatgccaacaaaatctgccaaaagttctcttaagggttgctctgagctaaaaatggcttctcaccttcagaaaacagcagctctgccacagtacttcatagccaattacgttattcatcgctaaaaccatcactacttacagccttgggcaaccgatggagatctttctggtcacctccgaggttcctccatttgctgatctggcttctggactcaatggatctctccttccaagatctatcttctctacttgggttcatctgcttacagctccaacagagaacaaatgcccatggtaatagcctggagagacttctagcactaagttacaagattagaaaagagctgagagtggtgctgcttctccctgccactcagcagtgaggattgatagtggctttcatcatcttttactgaaacagggagggaaatgcaagccttaatctaggaagaagagtccaagaggcttatagctccacagagggtttttccaatggaataaatttggttctcagcaagtgttttcagatttttgacacagtaagactcatgactggtgcccaggatgttctgaatgcacctgtctctatagctttgctgccaaacatattctgccaaaaaggaagcttcctagcatggtgcacagagtagagctgctatagtaccacacagattcaggggaggcaaagagagtgggccaagagaaaaatattaaaaggagctgaatctgcctaaagacacatttgttctgatttctgaaattctttcagaaagcaaacagcaggtaataattctgcgttcatgagtggagtctagggatgttaccaagttgttcacttctaaatcagtcatatctaaatcacacgtttgtgaacaaagtataggcaatctgaagccacatactttttaaactatgttagagttacaactacctaggaaatgtcatatttaacttctggtcttggtaaaactttt

SEQ ID NO: 2646 - DNA, 1373 bp, Homo sapiens
acagtgagaacagacctttttattaatatattgagataaactacagagactgaaagacaaaaattcatatttcattcagaacattcattaaaaatcaaatgcatttgagttctcacagaaaattttatgtaagtctgatataacattaaatattttacaaatcagacatttcattttgaaatctaatttttaatcctgaatgcattatagacaaagtaagctctcctttaccaatttcatttaacttatacaaggcttccattataattccatcaaaccttaaaaattacctgcagcttttaaaaacacataaagtaaatggaaagaaagtcttatgtagcaatccaaaaactaaaactagaaattggcaagaagcatttcttaatacagataaactgcaaaatatcatttatgtgtgtttcttctcattggtttaatcatcctattaaaaataattttttgaaagtaataattacaatactccaatgtcactgaaaatctctatgattttaatggtgtccttaaatggcaaagtagaatatcagactgaaatgtacagagtgttgtgctgaagtgaatgagacttgccatgccaggtgtcatctgctatgcagttacaagacatcttggcaactagtcatcccagtttttactaacttactaaacaaggacatttcaagaaatacttcttacccctatgtatttccagatggctggatatagaaagatataattatgtttgaagcatgggccttataataggaatctctccattaaaatatgaaaaagagcaacaaataattcacaccaatgaaattgtgttgactgattttcaaagtcagacataaaaatatccactgctaatggaagccctgctctgtgcaaacatagtgtggtatatattaaacaatcacacatttgaggtaattagctgggaaaaaaaaaaaaaatatatatatatatatatacacctatacatagacacatccacagaatattcacaaatctattggccccaacaccagcagatagtcatattaaatgaaaaatatcacataccaacaggaaaaagttacacatagggaatatacaaaaaatatggtgctataatccttaatataaggagtatgttttgaattaatgttttgaggaaaagtgtttccatttatatgaaagtatctatttaatagtaataaaaccaaaaaggaagctgaattctaggactgttttacctgccaaataattgaagggatgagcaagaattccttgaaaagcctcattctatcctttttctttgtaactaaaaattagaatttaaaatgttggaaattattgccagacaagtttcttttcattggtttatagggaatttt

SEQ ID NO: 2647 - DNA, 1381 bp, Homo sapiens
ataaaaactcaacacacattggattttaatgagaaaataactgtatacttgcattgaatgcctcacaatcactctaaaaccaaagcaggataataacatttaagtggttaacatacacaggaaaaccagatacagagtataatttccaaacacagtattgctgcttttttcccctcctcccccaaaaaaagaaaaacaaagaaaaaataatttgggtaaagagcaacacaaaatcaaaattggcagctcactgaatgcttaaaattcaggaaatttgttctttaactaaaatggaatatattcaccatctctaacacttaggctacttttttttcaatacatagtttaattaaatccattctttagttgggaaaaaaaaggtttaattatttgtcttcagagacaagaatcaacactgttttagtgttccttgttacactttatatatatatatgtgtgtgtgtatatatatgtggacattgatctatatacggcttatatgtcattgtctagggtgagcagcatgcatgggtatgaagaggcaagtaaactgcattgtgtcatccaagtaaaacacagcacggcctcctgccactgacagaccctgtttccataatttctggatgagaaagccaagtcatgtcagtagttaatcagctctggaggaaagtgaacacctataaacacggcagaatgcaatacttccagaaaggcttttaacacctacagaatctaaacattttgtaagaggtggggttaacaagcttgtgtgctatttgggggtggggctgagcatcagaggcaaagtttttcgtaagcctctttctctcgatggattaggcaggaatgactttcctccaggggacggtcccatcttcagaaagttaaaagggtccatttgggatcccagagcctagcacggtgctatgtacaaagcggtggcccaaggtttcttgaatgaataaaaaactcaagagcacagagaaaatctggctctcccaagtaaactgtaatttacattttcatgggattataataggatcttcagtgagtggagcaagaagatagacagcagtaatccggaaggcagcataggagtaatagcaaaagttaagagatgtaggggccacagtgaaaacagctttgtgactgtgggagagtcccagaaacagtatttctttccttatccacacacggagcatggcccaagaacccccagctctagaactctgttattctttaagcaataagtgctctggttcaatcaactgtggtcaaagaccacttcatctgcctctaaagccattccgcgaatagtgtggcctcttaagcttttctctttagctgtacattctcttgtcaactgtaggtttcatgaagc

SEQ ID NO: 2648 - DNA, 877 bp, Homo sapiens
gaatggagatgaaaactatcatttatttcaattgaatttagtttcattaaaaaattctatgataacattaaaacagaaacaggacgtttatatgactgtctttaacctcaaaagtccaaataaacatatagacattttgaatatagctatcattttaacaaacctcattatgatcactgttgcaatttcagtcacctaaaatacgaaccatgactattaataaacatttactgtgtgtggtttgttggactgaacattaaccatacgtgtatttctaagtactaggagttgaacagctactacggtcaatgtattttggcagttagctgtgtgtggtgtgtgctttttaaggcttcactcaataaaacatctgttgctctctgctgatgagcaaaaaacttgctatacgaaggacaaatatatgtatacaaacaaatgcacacgtgtgcatgtctatatacatatatgcaatttcagggaggtgacaccttattctgagaggtcatgagactccacttcaaaccataatagtaaaacctttagtaaactgaactcaacatattacagccaccatcatcaggaaaaattaaagactcatagttcaaataaagtacaaaaggtcccaggaagtattgtggtttgttgattcattcaacagaaagcccaaatgacaatgctattagtggtcaggagtaaactaacctggacaggctcatgaaaatgaacccctggatgcatcctgagaacgtactgcataattatagtcaatgcttgcaataattttcagtttgtctcatcacgttagcagagcctattcatgcaatttagaaaggatttcaatacagcccaaaccaaaaggcttacagtcaacagaggg

SEQ ID NO: 2649 - DNA, 1227 bp, Homo sapiens
  Modified_base 890: n = a,c,g, or t
cttatttaaggtagccttttattctgattaattaagatacatctttaagggttattctggtggtaagaacatttatcttgacttatgtttaatttttttaatgctttggcagatgaagtaacatttgaaaactgtttgtgaaaatagtatgagactggaaagattacgtcgtggtaaaagtttcacagttttccaggtatttccttatactgaagaggccttgaggcaaattcaacattctggaagcccagactgacaaagcaaaacagattttgatgttgcctttgttgggtcctggaaatgatgctgctgcttggccaggcaggaggaagttttataatccatcaagcttcccagacagtcaaggccggaggtcgctcctgtcctgtggtctgaccctcagccaggccatattactggaagaaagatactaagatttgcttgccaataataatttaagtttttaaataaatatttaagtgccatgtttagcatctatttgtcctggcaacacagcacttgttgccccaggacccagcttcttcagcgcatgaagccacagattcagtcaattcggtttccacaaattgtgaacctgtctatctctaacaaatctttctttgaggatctgtgttttaattcagaattgtcctgcgttatgtccttctcgtcaccatctggagttgtcaaaaactgatcagaattgcttgtcacaagtaatggtatgatattttccttttgatgaataggttgtttggtgatggaggcagacaggttttcttctgtggaaaggccttgagagggtttacatttgttctgtgatttactggacggcttgcctggagtgcaggttgcgggaggattcgacagcttctcttccattttggctncccttcacatactggcacgatttccccaacagcacgatgctattaagtactttcagggatatcaacccaaaatagaagagtatgacacaggcataagacaggattccttgcactttaattgagcttgttacaactctgatgagtaaaacagctagtgggagaggaataaagcccatcctccgtgctacagagtcactgtaatcagtgtatgcatttttctgtcggctgctaacaaggtcaaaagcaagactggctctatattcactgtagacatctgcagtaatgtcattgaatttagtaataaaggcatgttttacaatatccacggcaatttctg

SEQ ID NO: 2650 - DNA, 1025 bp, Homo sapiens
ttacctacaatggtcaattttattacaaagaactgtatcaaaatatacaagtctgtttaagaacaaccaagaaatgcagctgtttaagggacaaatgagaatcaaccgttagagagcaggcagcctctccccgccgctgtccactgcaggagacggcatcctcagggccacattttccacgggacatccttctgaataatttaaagggtaagtccggcacattacaggtcttcgcgggagggcagctgtgtcgggctttctccttctgtggcttcagcctctgccggcggcacacaggcatcttccgtttcttcgaagccgtcaggacacacacagacgtagctccctggagtattgtagcagttttcgtttttcctcacacaggttttttctgctagtgagcactcgtccacatctgcacactgtccgtgctccctcgcgtagccagagatacactctttacagtttcctgggccttcccctgtgcagcccacacagctggagtcacactcttcgcacgtgtaggagccgttggcgttcttacagaactgcgcagcgctgcagggacggtcggccgcacactcgtccacatccacacaggcgccctcgtccagcacccagcccacttcacactcgccgcagtctctgttggtcaggcccgagcacgtcttgcaggactcgtcacaggctgtgcagatgctgtgggtctcgttccggagcgagctgaagtagccgtccatgcagtcagtgcacagcgggccctggtaccccatgtggcaccggcaggacccgtcgccctgtctgctcccatctccgctgcagtggccattcccgctgcagggcctctgggatccgccctggcatgcgagacagtcgggaccgtaggttcctggagagcagcacactttcagtgtcttcacacaaaaccactcgaataagtcaggatattcgctcttcagctgcagccaccaggcctccaggtgctcctcctgcgcctctagcatctgattgcattcgaagtcgcg

SEQ ID NO: 2651 - DNA, 1197 bp, Homo sapiens
atgtattttgaaaagtatttacttagtttaaataaattaattgcaaataaaaattaagctacaatatatagcctgaataaaaatgactagaacaaatacaacacaggacttgctttcttgcattagtcacaaagcatgtgacaatctagaaaacttcaaaatcaattacatttctttgaaaaaggggtaacagcagttactgatacatcacaactaataaacttataatacaagtttcctgacatgcatttcctgagtgaacccaaatgatcattttttaaaacaaggaagtttcgacagttgaagtaaaataaaataattcatggcttctaagcaacaagttttgttttttaaaaaccaaaagaaaattcagaacagttttgtaataggataaattaaaggtatgctaccacatataaaactttgctacagtcagttaagtattatacaacttttcaaactaaaggaaaacaaatcaaaatattaaaagaagatactgtctaatctaaaagtgtactggtttctacaagtgtcaaaaaaagatttgatgtagtgcaactgtctatacttgtggtgcctttgaaaaaagggtgggaaggaggggagagaagaaacttttcttgcttctggaagcaaaagacatattggaattagagaataaacagaccatgcagtgcgtcactccacgctgcagtcattggtgctcatctgccaaccaaacatttccttaagtctcactgtggcaatctccttaggattcaaacccagagttaaggctggtctgctaaaaacgggggcactattgtcattcaaccctttagatctctagatttcctaatgcccgaataaggccaaatacagaataattaattaagcatttctttttccaaaagcaaatcaagtcactctcctttcttgctaatttatactttttcttatggcaatgatttttttctagaaacagtgaacagatgaaccacagtttatatccaaaaaataaacttgccaaatgctgctgatactaaaaacagattagttatcatgggagaaaaatagataatctagattaaattgcatatccaaaggagcatataaaatgtttcttagcattaagtttttgttatagtactacgctcgagagaaacattaagaaaaaatctttcctgattatcttcaatgttgttaaaaacaaacacc

SEQ ID NO: 2652 - DNA, 2135 bp, Homo sapiens
aagagtatttattccaaacacaatgttcactttaaatgcaaaatagctggtagaaaaaaaacactgaaaaatatactgaccctttgccccatatacagacatcagcctttggtatttgctttcaggtaattaggtaaaacaaacaaacaaaaacttgaaactattatttatctccaagaaaacaacgtagagttgaggtattctatttaacagatgtgatctccatccaataaggtctctctgttaattaacagccttgtgacatgctgttccaatcctttcctcctaaagtagaatttcatttgagcatatgttcataaaactgacagtgttccttaataatcactaaggttgccatagaaactccctggtgctggtgcccagccgcacggaggacaggaggccttcacagggcactgaggagggcctggcacggaccctgaactggcccgcctgcccctccgtgtgcagcccctgcccacggctgcacgggacagctgggtgcagggctcttgcctcaaagggtcacaggttgcccctgcatctccaaattaagaccaccaactccacctggagctggtgtcagcatcctccccacctgggttagccttctggacgtgctgtgagataatagagctcagcaccaaagcagctgggaagacattcctgaacattctccaggaaacaaacccatagaccacaacatgcccagcctgccccactgggccctgttcactaccaggtgggcttccagcctggttccagcaacagattccacaacctgccgcggcaaccagtttcctttctcccaagacagcagggaagtgccagaggctccgtgtgaactcagagcctgataaaagaaagcgtaagggcaagtccccatcagggccaagagctctctgagttaccaaaggcctcgtcaacatagccagtgctacccctggacacatttcttgaaaatatttcattaatgctacaaacattattgatcattttactttaggccttgaaccagcatattttttactttccccacccagcaggataagctgtcgtatttaacctaaatggtctctgtctcagcgtttcacgtctggctgcgtggcagatggctacaggtgttaggcaaataacagcactgctggggactcaaggcagtgggggtgctgcagaaacacaggtagaaatgccccgtgcattgagacacatgttcagtcaccacagattagagaacatagagagcttaggatgtatacctgtgtacgctgagccaggcctacagcccagagaagacattttttcttcatttacattagcttatgaaaaataaagggaaaacaaccctcttcaatacaaaaacaaaaaaacaaaacaaagcaattccattacaataaaaatgaaagcaataacaatttggagatcaaagctgcctagctcttggcaataatgagctatctggatttcacatcttccgctagcatggttctgcccggctttggtaacaccacatgtgggtaaaacggtataaagaattgaagaactgtgggcacagaatcacccttactgcagattctcattcttaatatttccctttaacagcattttgctgttctcaagtctcagaaactttatgtggtgggatgggagggaaccaccataaccgcctgcctgcctttttttttcttaactgttattgttcataatagagatggtgtctcactatgttacccaggttggtctcaaactcctgagctcaagcaatcctcccaccttggcctcccaaagtgctaggattacaggcgtgagccaccgcgcccggccatcctgcctttttgccaacctaagatgagttgcctcaagcagcaatagggtctaaaatctacagacaagcccagcaatgaaaatcacggcttactgaagacagtaacagcttaaacctggaaaaccgtaaacaaaacatggtcactttcatcctttcgcacctgtctggtgatggtggtggtttttctaagagggtagagtattagaaaagttttgtggtctggtaaattttgggtccatggttacacggctgatttaaatcatatccccactctggaataccctgataacttgagagctaactgggtaac

SEQ ID NO: 2653 - DNA, 1116 bp, Homo sapiens
atacttaaattaaatagcatgatttaatttagttggtgcttaaccctgaatcctcttaagttaaaaaaaaagttataattaactattaacgttaatgaatttaaaccttccagaaagcatgaatccaaaaggaaatgtccaacaggtgatatgaaccagatattttatggcctttcctgtttcagtctcaaactttctaaacatcaatggggaaaaaaaattctctagagtttttcagttttattcttctagagcacaattttccggcctgttactgagtacggtcttctaacaggtacacaattaactcataagtagacaacacaatggcagtatttgggatctgccggataagctgggcaaacagtcctctataaaaggcaaggtagccttcttcccggaacaccaggcgcgccgtctggacaaaagacttgtacttggtgccctcttcccggagcctcgtccttatgacttcgtgtggataagcaatgcaggaggcacagcccttagaaagagcagcagctgccataagtccaaaaaaacttgtggaatttttctcagtcccatttgcagaagaggctaatggagcttctttcagatacttctttaaactttcataaatagcaaagcagattatagtttcggaaattccagcatacgaggcagttaatcctctatagaagccacgaatgcttcggtctggtaaacgtaacgagcacactggagtgtattcatctgcttagagcccctcactttctgttctagctgcattcgggttttaaccatccatataggattcattaaggaatttgtgataaaagctgcagagccagctgagaaaagatgcacaatattgctgttaggcacgaaaatgccattaaattgctctttggctttggagtaacatgcaaagtatacagccttcagaacctgaaagagtccaggtgtcacggatgttggtctcaccattccagctccactaatggtccccagatgaacctgaggatagtagactgtccggagagctaatcttgaagactgcaaccgtgtcttaatgacttctagtggacaagtgaaaatagcaccaactgtgcctccacacccgccggcgaagag

SEQ ID NO: 2654 - DNA, 1118 bp, Homo sapiens
acatatacctttttaaagtaacatttaaaattacttcctttaatataaaagaaacacacaagacacaaagaaagcccaataaagctgtgagtcccagtttggtagctgaggaggagtctaagaaaacaagccattcctcagtatccctgggaaagaaggggtgagaggacacagatatcaccaggccctgggtgactgcattgctggggccatgcagggcctagctctccaccaagggaaagtgctgattttccttgtcatggtcctggccttgctcccatgctcgtcctccagttttcagaagtcgtccagttccaagaatggctccttcctttagttcactaacattttcacttaggggtgaaggccgcttaccctgtcgtagtgtcagggtgccaggggagttgtcatcctgcaggatggtgaggggggatctccctagtaccttgctgctgtttggtttccatctattgcgcatagaacctgaagatctgggagtctcagggtcccttgagggcttgtcggagctctggctggccacaggggtttctgtgggctgtcttgcttcctccttggaaaacacctgtttggaggggaactcagtctggttccaaggtggcatctgttcctcaacagataactgggtacccagaggcaagtccaattcagaagataaaggtgcctctgggggcagaacaggctctgggggaagatttgatttagagtcttcagtttcaaatacttcactcagctgtttcaccagtgggcttggggggtctccactgctggtcttcataggtgtccgtgcaataccaagagtaggagagcggggatctgagtcctgggcatgtttaagaccctccagttgctcccctgctggtaggcctggctgtggagagctctccacctggatgggagtgcgcaggatgccagcactaggtgaacgggggtccgccactcgagccagatgcttgttgtcggcggaggccgcgctggtgtgactgggacgctcttggctgagcccatctcaaccaggagttgcagggtgggggcaagggccagcccgggacgaggagggaatgccgggccccaattccacctctggatgcacaacagct

SEQ ID NO: 2655 - DNA, 1551 bp, Homo sapiens
atttttcttcttccttgtaaataatttaaacagtatttatttttgtaaggcataactagaaactaaaatatattctaaaaaattcattattctgaacaaagtgatcaaattagaatacatatttttcaacagtggtagagcttttaatatatgtttattgaaagttatctataatacttgcaccagtgttgaaaaaagttaacatgtaggcaagagcaatatgtttgtctcaaggatttttccatggtttcctcagtgatggtgtcctgggattattcaggtggtgaccatcactggtctaagtttgtgtgcagggttttcagacgtgtttttgtgaaacttcgtagaaccatcgctaataaagaggacagtgttgtcagggtccatctgccctccatagaaaaatgtctctggctcataaaatgagactccctcaggggcgtaaatatgaactgacagcagtaactctgatacagaataatctaaattgcatcaaatggccttaattcagagtttgttaggcttatcagtatgttgcttttaattggggtgggaaagtagagggagagaaagcaagacatttattaagcacctcgtatgtgccaggcactatgctaagcactttacataagttaggattaatccctgcaagaatcctataaagaatgttactagcatttacacttcccaaatgaaggtaccaaagctcaaacgcaatgttgtgaagctgtttccttcagatttaggttatgtgggatgatgtgggattgaagaggaaagaaaggtgggattatccccctaggaagactttcaggcctgacttcataggaattcatccatcttatcatgtggagtttatctcaccctgctgttgcaggatgctatttgcatgtgtcaccaggtgatgttttttctttggggagtaggggtttggcttcctcattcatccctcttgctaaaagaggagatagttgatgttgcatctaaagatgctataagacaatgaaagtttgatgttgtacatacctacaagtaccatttttgtgcatgattacactccactgacatcttccaagtactgcatgtgattgaataagaaacaagaaagtgaccacaccaaagcctccctggctggtgtacagggatcaggtccacagtggtgcagattcaaccaccacccagggagtgcttgcagactctgcatagatgttgctgcatgcgtcccatgtgcctgtcagaatggcagtgtttaattctcttgaaagaaagttatttgctcactatccccagcctcaaggagccaaggaagagtcattcacatggaaggtccgggactggtcagccactctgacttttctaccacattaaattctccattacatctcactattggtaatggcttaagtgtaaagagccatgatgtgtatattaagctatgtgccacatatttatttttagactctccacagcattcatgtcaatatgggattaatgcctaaactttgtaaatattgtacagtttgtaaatcaatgaataaaggttttgagtgt

SEQ ID NO: 2656 - DNA, 613 bp, Homo sapiens
gaatttaatcaacgtgttcacacacagcatttattttgtaagattaatttttacaaaccatccacaacttgttcaaacctttggctttatcctatctaatttcaaacaaatgcccagccttaatttattacaattatgattcgtagactttcactcaattacataaattcactctcggttgaggaaaagagagaggtggcagaggattaatccaaaggatcctggtgtccactacccttcaaagccagaccctggtggggcaagtcctgccaagtcatcaggtgctgattaaatgcagggcactgggtgggaagcaaattcctaaaatgtggttctttcccagaagcatcttataatctagctcaggggcttgcagctccaactcactccggaatcacctgggagcttctgaaaccattctgatcctgaactccaccctaaataaatcaaaactcttggtccataaactgaaaaaaaaaagtttaatctccacaggacattctaatgggcagccagagaggagatccactgatctaggtttttcataaattacttaaaaatttgcaaattataaaatatttcattaaagtatgaaaatctgaatcagttttgg

SEQ ID NO: 2657 - DNA, 1127 bp, Homo sapiens
aacacacagagcagctgcggagcgactttattgtcttctccttcgacagcttcgttgtacatagctgggcccccgaggccctgactgtccctgggaaccaagccacgtggggtgaagctactttgaaacctcacccacagttcacacgtggtgaaagagaaaatctagcaaagtaaatccaacaacaacccaaattaacagtattattaacttcctaccccaagctggctctcccccaggccctgaactggctcaggaaggaggcaggaatgagctgaccgagacaaggcatcctccacccacacatcccatcttctgagtggtcccagagctgtgcgccacccctgtgggacaatcaggcactcctgggtctctaccagctgtgatgagacgtacaagaggagggtctgagcccagaataaacaagagcatcctgaggctggagaggcaggcccagtgtgcccggaccaccctgctctgcctgagaggatgggctgggttccagctggcccggccgccacctagtgactgcttgggacagtggagatgatgacaggatgcccactcgcccctaggcagtcagaagcggggtacacacaaacactctagaagccacacttagcaggaattcccagtcttccggcccaggggagggtgccaccagctcaggcagccctcaagaggaggccgggagcaacttctccagggccttcttctgcttctcggtgctgcagccagggcctcaaccagcttctcctcgggcatcatgttgagcaccttgagggcaaagaggagctggcacttagccgtgctcacgaaggcgttgctcaggaagttggggaagcctccgactcggtccttctgggtgtacagcgggacccgcacgaggcccacgcacctccaaggccgtggtcgcgcgagtgcaccgcgctgatctccacggcgtgcagctgctccagcgtcagtgccgcgcgtacaggtgcgccacgacgcggtgtgggccctcggtcaggtgcgagctcaggtagtcgcctcggtgaggcgcaggcagcccagcccaggccagcacccggttcaggccgtcctccagcgaccagaagcgccggtccacgaagccccgggaagcc

SEQ ID NO: 2658 - DNA, 1780 bp, Homo sapiens
gcctgctgctatatctgaggttgtacttttgttctgatctttgtaacacctcaaaaaaaaaaatgggttaagagaaggatgaacagaagaatggatatgagacctatctgataaggcaagcagattaatagacgaatggaggaatgtttggatgtatatgtatatgtgttcattgcagttttcaactttttgtgttgaaatttttataaaaagaagttggagaaataaaaaacaagaaaacagaaccataagatttttatttaacatttttgattaaaggaattgtattgcaaattatgactttttaatttggcaacatccttttaatggtgttctttctttgtccttctctttctcttcctctctctctccctctcttccctaaagctccattccgacttagacaagggaaagggcactgcgaaatacaccctctcaggagatggcgctggcaccgtttttaccattgatgaaaccacaggggacattcatgcaataaggagcctagatagagaagaaaaacctttctacactcttcgtgctcaggctgtggacatagaaaccagaaagcccctggagcctgaatcagaattcatcatcaaagtgcaggatattaatgataatgagccaaagttttgggatggaccttatgttgctactgtcccagaaatgtctcctgtgggtgagtaggcaaatcaaaattctgtgagatacaatgagacctcttcaacattgactttttgcaggttgatgtaaacatcttatctatcatctaaaagaattatttttcaattctagaaaatacagttcttttcatttatttttgtaacttttttgtttttctttctgcttcattatgaagataactacaggaatatataacattagttcctgttttccaccctgtgaatttacctgaattcatagaatccttgcgtgctttaagcaaaaaatgtattttgtattgaaattgattcttatctcaattccagacacctatacagtgctggagacacctaccctacaccacgaaatgccagacagtaattcctagatcaaagtaaatgatctaaagcatgcatcacatctgatctggaagtggtccagaaacaggtgtgttgcatcttctgtagctgtaaatagagattctggaagggtgatactgtttccttttcagggtaaataacccatacttgttatgccatcaagccaagcagcaaatgaataatgtcatgaaaatattattagaacaaattaacaaattacaattacaattatcaaattaacaattagaatatagtagcaccatcattctaaaaatttaaatttgatataaatatacatttccatatcagcctaaatttacaaagtcctataatatgtaggatataaggtcaataagttaagaattccagccttaaggacaattttaaattataatttttattcctcagtcaccactgctaatccttcaatttatttcaaagtaacttctggtttttattacatttggaagataaagcaacttatcacatgtaggttacaacttaaaattcgtgtatgagccattgcttatattttctaaatctgacatgacccagggggtttctactgctcctaccaccacccaggacatgcgatgaagattgtgcacgctaccgtgagggcagaagcaggttagtagctgtaggagctgtcacatggatttactataatgcacttgaaattgtgtatgtgaccttatcaggcatttaaggaccataatctctccttgacctaa

SEQ ID NO: 2659 - DNA, 1472 bp, Homo sapiens
gaaattttagatttctttatgttttaacaaattaacaacaatgataagaggacattagcagcttttcttgggtctctttgttaacaataactcgatcctgcagccataacaggggatgtggccaagttttagctggcagaccagtaagccaatattttacacaatggatgacatttctgaaagcagaggcagagacagacccaaagtcacacatgtagtccaacaaacaagtttctgccatttttaattgtatttagagcaacaaaagattccaagattacaaaaagagaacagaacactagcgcttggagctggtcctgctgcccagtggaggccaagtgccaccgtgagaaataagccccatctaaagagatttcaagcaaaattgtttcttttaagaaaatctttgtgtgatgctttctttctctctctcttatttcttttttccttcaatattgaaaattaatttttatctctgtttacatagtctgctccctcctgctgccagattaattccaaggacagcacaagaatgtcatgtctgaggcactccctaatcaatgttccagtctagaggaaagcagaaaggtgtcactgggttgtgaggggactttttaattttttttttcttttttttgcgtgggtcattctgatggtggctgctgtcagcatccaagtggcttatgggataggacaaccccccaggcacttcactgtaggacagttagcaccaagggctaaggttgtgagataatgcaaatctggcctgtcacctctgcagagtacaggttcccatactgtgaggcagcagccagagagggaaccaccagagaaacagcatttcagaattgtctttcctttggtgtatggatatgtgtgtgttctagtctttggtgggcaatggaatctgcagctccatgacaatcttgttaagtagcttatgtgggaagtgtttcaggtcacaagggccacccattctaaggcttctcatttaattccccaggctaagagacaggtggggaaaggaaaaaacctagcaccttgctatactgaattggaatcagaagccaatcaatgcatattacctactttctggccaaatcaaatgaggataaatcaaagctgagtcaaaagctgtttttactatgaaactccacctgctaaattcaaatatctaccactctttctatgggtgaaaaaattccaaaagatttgttatctcagctgaaatgtctgaagaggagtaactaatgtggatttttctgccttcacctagaaatggttgagttgggaggtcctaggcaacagaagtgtcaatctcttaatcaaagaaaaacaccctacctgtgggcagaaatggacctgcacctacagagatacaacttctagtactctgacaagttttaacagagaaaaacacattttcatttgtcaaaatctttacagaacatatccaaaaccagaattacagc

SEQ ID NO: 2660 - DNA, 1407 bp, Homo sapiens
aaaggtcttgcaactgcaattttattttcttttgtgaaaataaacaactgggagtttaaattgctccaaaaaccataaaaacaaaaagaaatacacacagaagaagcatgtgaggtgatggggaagggaacagggtctctagaactttggcagattgtgctggcacggacccaggtgacaggagccagaccatggggccggtcccgcctgccactctgggattgtgaagggatgatcgccactggcaaggacggggaggaacacagacttcttcgctgaggaagtggcaggcaccttgagtccctttaaatgcgggggttgggaggaaaccatttcagaggaccgctttctccactgaaagctggggctggcgagttcgggcccactgagggaggggacgctggtggcagcaaatcaggccaagatgtcttctcacatggtgatggcctcacactgggcagaggacagaggacgaagaagaacccacggtattgagcagacgatgaaaacttgggctgggtaacaggaaatgtcacaatggcagagctgcagatggagtcggggaagctggggcaggcggcaggggcgagaagagacaggagacagaaagtgcaagagaggtaagagagagaagtgccctctgcccaggtccatccaccacagcacctacaggacgaatagcacgctacttttcagttctctttcttataaagatttttttttgttgttttgttttgttttttaaaaaagccttaagatcagctactggttacatctacaaactgtaaagtgctgttgttaccagccactttacagaacagtccagagtggtcaaatattgaccaataaagtctcctttttctttttcttctgaatcattactactcaatgagtcatgtgacagcctgcaggggtcggggggagcttagtgggcagacttggtgaccagggaaagaggctgggcctgtagcaccgggagggcctggtgggcatggagcgtggcggggaaggacgggggagaggccagcagagctgtgggcatggacccaagggggaggggccgggacaggaggggaggctggctgcccatctgcccagaggaggaggctgcagccttagccgacaggaaggcggcagagtggagagccagctgggcccgggtttctggtttggtggtgagggagaggggctgggcttgctccgaatgggtggcagcaggggcagctggtgaggccaaagctgcagagggagtggccggggagtccagcatgctcccgtgggaggaggcagggctgtcacagggcttctcggggggcaggtactgaacacatggcttcttgctcttggagcccagggcaccctctgcctcctaaacttgctgctgtgactgtgtctgggacagctgct

SEQ ID NO: 2661 - DNA, 1104 bp, Homo sapiens
catattttaggaatatatatttttaaaaggattcaataatctttttaaagcaaaatcaaagtatggctacaggaggagaggaaatatccaaattgtaatcaatgcagattgtttacttaaggccttatatttgtacctgtataaataccatatcacagcacaaaaacataccccatctggctctcttaaggtacatgataaatcagactaatgcacattcatcaaagtggcatcatctcaggatatgtgcatatttgacgtgggtatgaattcagggtttccttgggtctctttcaaggactctcctttctcgtcggtatttctatttccttattttccttctgtttatgaagaactgttatttttatatttaatgcccaattttcactacttgttcatgtcagttctctgaaatgttactgcctatgaaccgtgacatgtactctttataacagaaccagaagttaaaagatgtagacatcacacaaatcaatgattattttaaaaatagaaaacaatgataaaaattcagttgccaacttagaggattttatacattatgaagtgttctattttccttccagggtctgaaatttatttctcaagaaaacagattttatttctaagcctttactatctttgctagaaacagaaaaaccagttttctctttgacaaaattgtcccaggagaacaacacaaatgctttttccaaattagagcataagtcttccttaaatgtcctagtgtgacaataaggatacaacagccatcttttaaatgtcatgaaggctattgttaagacggtgtttttggccgttttgcagatggtccatcgaagttagttctgttatcaatgttattttcatcttctgcatcatcttcatcatcaccgtccaagtcctcgtctggagccgccgccacccggtgctgcacttccccctgtaccagagggtcgaataattccgttaccatgtccttcatctgggccacgccagacaacaggccctggaaagggtcgccgtcacccggcgcctcacaggacacccgcagcttctgcggcttcccttcctgcccgacgtactctcccagcagctccatggtga

SEQ ID NO: 2662 - DNA, 1669 bp, Homo sapiens
gcatacagaattattttatttaacttaaaccatgtagtactttactagaaaaaagcagagtaagagaaactaacgttgccttagcttcagccattcaaaatagacagtttcttttttccattatgtaaagaatccagagtatatcgcaataacaggaataaattcttacaacagaatatacaaaaacattttgaaatttttttcatctactgattttttatataaacaggattttttaggaataatttatacacagaaagtcattttatgtaacaaattggccatgttattacctttttttttcttacttaaaaaaatttttttttaacaagaaaactcagaaaatgcattatttgcggtgcatccattccatcccgccttctggtttgattttttttatcccagacaaagggatacccagaggtagacaaactctggcaaacctctcacctcaacctcactggcttagaaagcagacaggtgttttcaccgggcgtctcttccaccggtggatgtgtgtgtgcaacgccaaacatccaaatgaaaagttgaaaacaaaacccaaatagtttccagatctttctcctatgtagcgcaaaaaccccaggtgtttcccatgatagagatattgtggagttggggagacatggccaacaatccactggagttagaggaagtggagtcaactttaaaaccaatttttgtgtatgttatagtttttattaaaaattcttttctgtattggaaatacgtatcttcggggttctgccttaaataaaatagggtctcttctgtgttctaacaaagcagtaatcaatcatgatacgaggcatgtaagcaaatggcctgtgtgccccatagctgtcatcgtttatgtgatcactgtgtatgctgtaatcatcatgaaaaccattggctgtgcagtcaagtcttcccatgtccatggcactgtgctgacaatgacggcagccagaccaatcaagccagatgccgaacggtgccatgcactgctgggctccaacacctcggctgtttccatggccaatgaggttctttccatctgttaaagtagctacactccaaagggaaatgaccagtaaaaaatgatccccttcccaaccagagggttctggaagaccaagatactgaagatacagaactactttttaaatcatcatcattcctttgttataaactagggcaaaaagcatggggggaaaagagggtgaaccacggatggggtcagggagaaatccttttttggcatattgtaaagctagctagtaaacaggtgtcctaaaaaaaaaaaaaaaatggatcacaaacacacatttgcacacacagagaaaaaaaaagtgtctttaaattattttcggcaattataaactacaaacattttataaaattattctgttcttacaaaaatgcaatgaaacatttaattagttcttgtaaaccagatcttcgtcaactgactacccgtaatctactggacttaagagccctattgaaaacgctaatgagtgactagttaaaacaatgttgaccagaaagatgcggacacacacacgtgggacataaaaatgagtgatcgttatgttctcgcagaaacaaaacgctaaagtcatgccccagaactgacaactgacgagtgcgatgtagtttgtgt

SEQ ID NO: 2663 - DNA, 515 bp, Homo sapiens
taatgttaattaactttattcacatttttccaagtaaatacaatattaactataagctaaaaacaatacatagttcttagaaaatacaaccccgaattattgtgtggcctgggctttgtgattatgtgcccagcctttgttcctccagaattttaaagtgaatgcagtgctcaaaacaaacttacgatagcacagggaaaccttccctaaataaagttttgttattagaagagaaatccaaaaagaggcctctactgccttcattcaagtgtcgagaatttcaaaatggaaataatattaaaagagcaatcgatttttttccatctcacactagtaggcttgaaggaggcaaatttggaccaaaaatctagacatagctccttgcatagggtttgatattaagcacacacttgcactgaataactccatatccaccctatagtacaaaaattcatttcaaatgcaaacgttgtgcaatgaccaggtcatatttttaagatcactctttaaaatat

SEQ ID NO: 2664 - DNA, 1498 bp, Homo sapiens
attagcattcctttattttagaagttcacacctataattttataacaatcgtgaaaatgttactcagaactagatgttttgatgacacatagcagaaatctgtggttcaagatggtcattgcaaacttaaccaatctcagcattctattctgccttttgttttgattgcacagaatcaatataattctgattcatatggaaaataacttaatatcttaacctccgctcaggatcttcatcataaatgtaggtcagtacatacctaaaaattgtcaatgatccaacatggtcacatgtgacatgctacacttgcacctagtaccaaacaagctgatacttcaatgagatctggttggcatatacacccaagccttgtctgtcccctcagagcactgcacacagatagtgaaagaacttgtgtacaataagaaattcacagggatgaggctgggcgcggtggctcacacctgtaatcccagcactttgggaggctgaggaaggcaaatcacttgaggtcaggagttcgaaactagcctggccaacatggtgaaactccgtctctactaaaaataaaaaacttagctgggcatggtggcaggtacgtgtagtcccagctactcaggaggctgaggcaggagaatggcttaaacccagcagatggaggttacagtgagccaagatcacaccactgcactccagcctgggtgacagagcgagactctgtctcaacaacaacaacaaagatattcacaaggatgaatttaaataggtaaatggcagtgtagaactacatccttcctagtcaattacacctttaggagactttaaataggcatagaaacgacaaagggcttatactgagaattgcacaaaaatgagttacttggcagcacaaggtagggattgtatgtgtcacaagagtatatagactgttctaccttcatgctctactcattgccatatcccttcgtggttccctgagactcaggtgaaattaccttccaatattgcctggagaagggcctcctcctcctcagctgcctcataatcctttattagtaccaataactgcaagaaaccaggggctgggccatcctctggcagattaagctctctgcgaattgttttgtggactgccccagcaatgacttggtctaggcgggcctgattcacagcatctctctcaattgctcctctctgtaccagcttctgtaacaaaggctccagccttagtacataagccgacaacttttcctcatccttctggtaagtggttagatatttgacctgcaactccctaggattatctgtaaccccaaatacctcctcaagagcctgcagacattcatcgacagtaattaaaggattgtttatcttgaggacacgaataacatcaagtgctgggcctcgaaggctctctagcaatcgccttctcttctctacatctggcacctgccacgcctttatcatctgagtagtatgaaacatccagcgtcca

SEQ ID NO: 2665 - DNA, 1510 bp, Homo sapiens
gattctcactttcatttattttcaaggcatatacaaaagtctgacatggtgcaatgatctcatcaagagataacagaacacacaggagagggttgggtttcctccccggcccaaccccctcaggaaggcacagaaaagtgaggcttgggttcgggggccacctgctttggaactaatctgctgctcagaaggccaggccccttctgaagagggatctcttcctcacatccagaatctaggatctggggaaggtaaactgaggccaccagtaagcatgtgctccaggccaaggctgagtctgtgctgcatccatgtcatcagccacccaagaaaaaccagttactccacctagctcatggtggcggcatcctccctgcaatggtgcatggggggcagtcctttcccctgcagggtgtcattgccacccccatcctcatcctggaggccagtccaggctccgatatgagtgactaggggtgaggtaggggtggcagaagggagatcaaactggagcattccagatgcctactactgccctcacacaacggggcaactgtgctctccaactcctccccttggcagagaaactggtcctgcagtttcaggactagacgagcgtggggtagtggcaataaaggggcttgtatgagaagtgtttcgcctctcatccctaggggcaaaaagtgaatcatctaactggtccaagtcactaatggcaatccttcttccccaagaagactgagtttcctttgtcacttcaggaagggaagaagagaggttagctgagccacccagattaggcccagatttagccaccacctagaacagggcaagctggaagtgaaagaacttgaaatactgactttttccttcttaaaaaagacctaacattgtaatggtttagcaaaattgttataatttcttttaaataacccacagacacccatgacacttccaaatttacagagcaaaaaagtgatttgcagctggttcctccagggaattggccccgaaggctggctcagttcacctccaggacctcagtctccgggaggccgaacttggtcttgtgcttgtcgaagagcttcaccagggcctccatgtacatggtgtggtacaggtcgatgtcttgctgggttgggtgctccagcttggggatggtgatgggctctcccacaacagtggtgatgggcttggagtagggcaccagcccccaggtgtcggaggagaagaggcctcgaccatggaagatgcatggggcgaaaccaatgtatttctggaacttcttctggacccatcggccccaggagccctcctcgaagatcacctgcttgtacacttcattctctccaaaggagtagatgggaaccaggtcagctccatgacgcagggccagtttcacaaagcccttgcggttccgcagggtgactgcattcttgccaggcatggagctcagagactcagccgcacccccgaccacgatgatgatagcattgccactcccattctt

SEQ ID NO: 2666 - DNA, 1198 bp, Homo sapiens
ttaaaccttcccttaaaggactttatttctctatttttatatggatcatttattaaattagaagactaaaaagtaaaaatatattttacaatcaaagaaaaatctggacaatggaccccagtaaaataatcagaagcgcacgttctgagaccactcctgcctggcaccctgcagggtagcgcccagggagcatctgcagaggggagaggagaggagggggagcctccggcgacctgtcttctatctccggagccccgcctgaggctccaagatggcacagtcaggctgtccttagtgaccgctgccacggagctggcgatcggcctgcatcttcaaacccaggagcaggagcagcagaggctggcaaggcctgggccctcagacaccaggggcctaaacccagctcccaaacccactgcagcctccccttgtgagctggcagacaagcctgtccttctgagtgtgacgacctcatccacacctgacacaggcgggggcgggggagggtgggggttgtgaaccagctaattctggggaccgctcggaggggctcagcaagctgcttctacagtaagccacttctacagtaagccttcaaacaggaaataaagcataaaatgaaggaaagaagaatcttatttaattaaaggccttgcaaaatgtgatttgtctattaaaaaaataaagcgcttgtgaaaaagaaaactaagagatggcggcaagcgtggtcatcggcaaagggttgctctccctccagcgaggctggcccccactgtgtgggtccctcgggcccccacacgggctgctcaagggctggcagcaggggccacgtcctctctaggagacacccacagagccacatgtgcacgcgtgtggcagtctcactgcaccccagcaacgcgaaggcagaaaccggtgctggtggccacacctgggcgcctggacaccgaagcccccagcacagtgaggcctctgagtgtggcttgtggtctgtcctgggttagagttgttaatatcacggaacataccatctagaacgttccagtcccgcctgacaccttcattcccaatggagaagaaatctacacaggcgtaagaccaggccatctgagacagggaatcccaggggcccctccgtctgagtggtcggcgtctgctgaacaaataccatgtctttcttcttcaaaggatcaaaggc

SEQ ID NO: 2667 - DNA, 970 bp, Homo sapiens
attattacatattaaaatttattttaaaaatacaccacatcagaaagcatattttacagtggtaaagcagcagtttttatttattacaaattctaaaaaagaatccaactttataagtaaaaaggaacactgatgatcacttaaaacatttaaatttaaaattactactaaaaaaaccctgtacattcacacaagtccaatgcctttgttggtttttacagacatagaatttctgtagggttttgggccctatcaacaatttttattaagtactgcaataacaaaatacagcaataaaacaactggacactcctaggggacaccaaagataaagggcccattaatcaggtgtaggccagagaaacccaacctgttggcaatatgacgctctttcccaactgggtcttggtgagacacgtggcacagcaaggctgtcagtgcatgtgcataaattgtagaccaggtcccactatgctacttcaggattcagccagcccttctatgagtcacagaggtcccttggtccttattcatcttgatatactcatgggatgtttggaattaaggagcccaaactaccttacttgcatttgaagtctttcacttcatatcctaccccatcagtctaagagcccacccaacaagggtagctacacatagatgctcacactctataggctgcctgatcctggaaccagcctggggccctgattatgatctccacggggctgtcagtggctagggaaagctctttaagacccagcgatcatggcagtggcatcaaccatggtgaatcaaagttaagtataatgctcccagcaaacagtgttaccagttgggttgagcaataacaaaatgcatttgaaatcagtaagactaaaccgtgtatatacaaacaataatgaatattacaaacaccaacaaccacaacaataacagatcaggcttctcaaaatccagaaaccggaag

SEQ ID NO: 2668 - DNA, 931 bp, Homo sapiens
caatttgttaaatgaaattgtattttgcccacggctgcttctgtttgatccctggggacagaggggagcaagggaggggagtggcagggggaggcccaggtgtggggctggagggggtactggcggcagcgggaggcagtaggcttgggcaggggaggagtgcgctgcgcctcaggaggcaaaggtgccccagcctgggcaggccctggaccagcccaagctgagcagcgccgcccctgggctggctctcagagcctgggctaacgtggagcccgccacgtcgcttggcactcagaggcccctgcttcttgttggctcacgtaggccacgctcaacacgtagcctgtgccacacccttcgaggcccgggtaggagggcagaggggctggtctgggctcttggtggacccctgctggtgctgcctgcctcctcctcccccacgtgggactcaagccaagggtcagaggcgcttccgctgctgggagcaagggaggagagtaggggtggagcagcctcccctctgcgtgggaacccggcctgtgtaagcagtagcgggacagggtggccggagtgatgccttggggcctgcggggaggagtggaagaagtggatgggctggctggctgtggcttgcatggcactggcagcccagcctggcttagaagtctggccggtccttcttcagcttcttatagtcagtggaaactgcaaggaacttgtattggtcattggggctcaggcggttccagggctccgggttgttctttctgtcccagcagacgtcggggctgcgaagggcgagtcgcagcaagtaaagcgcagcgctgcccatgcccaggcagattaagccgatcatcgggatgatccccggatgtcttttgatctgccggtagaagcgggccccaagactggctcctgccatatcgttgtt

SEQ ID NO: 2669 - DNA, 687 bp, Homo sapiens
caccagacggtcttcaggtttatttcttaaatcaattaggaaataaaaccacagtgcccaggaaagttcacatgagacgccacggtgtctcttgccatggccccaccactccaggggccagggggtgctgctggagggaggacagacggacaggcggcctgggtggccggccccagaaaggctggcgtggatgttcgagatgagccaccagcgaagccagtagggatgtctgggccgtcctggtgggattgtctgggacatcgccaccaacacggtgtcagagccatcagtggggacatcggaggggccaccaccaggtggggtatattcaacaggctagaacccctgaggcttgagaggccaacccccggcaggagacctcccctgacccctctgctgcctctcctgtgggaccctccagtagacacaccagatgaggacacccaggaggcctcctcccaggacaggaggcagctggctgggcagccacgcagtgcagggttcagggccctccagcaggagctccatggagatggctaaatggggacatcaaggcaggggctgacagtggtgacatccaagtggtcacagtcaattccggaagctttcagggcatcaggaggggaaggtggggctggggaaatgtgacaggaacggggaagtgcaaaaggcaattgcctagcctgg

SEQ ID NO: 2670 - DNA, 1596 bp, Homo sapiens
taggtaaaacaggatgtaaagtttatatacaagaatataatgtttatctgaaatatttacagtgttggttaaagcaatatttttacaacttttaaaggtaaactactatgtatattacaggtaagctacaatgggtttaatttgcaaaagttaagtaagaaatgttttaaacaaggcttaaagtactcaagtcaattataaaatttatatcttttgccttttacttgaagaaatcatgctatagaaatggttaatgtgcttctaataaatggaagtattgtagctggaatgtgatacatgtaacagtttaagttcccattgaaggtataaaatgatgaattgttgtaagacttagacactgagtctcagtctggagctgatgaagatgttgagataacagccagctttatctcaacagggtttgtgacccacaagtttgggccacagagaaaattgaagcaatttgcatgttatgacaacctcagtgggaagtgaaaatcagctgactcaaaacaacaaacaacaaccaaccagacccaagtcacagttgcacctattcaaaactagctttaaagtgagctatttttaaacttcataaaaatattcatgattttattagtttgaatatttctacaagattcgggtgggcttttcctttaggtgaaaacagctatccactcctgtggccttataactcaggaaatgctggggatgcaaacgtgcaaaaggcagggggaagctgcccaggctgagactggagcagctaggagtgtgcttggggaacgggagctgagatcccggagcagaaatggtcagccgtgctctggagcaggcctgtcggagccatcaggatgccgggactagcactgcagcttgcggatgctgcgggagatgcgcttgaactctctctgccccttctgccaccgcttcaccgaggtgatcaccagctccccaccctgtttctgtcccatgaccagatagggcgcgttgatgtcgttcatctcctcacaggtgcactgcaagctgtctttgagccacagcaccgatttcttcaggtcctttcggacacaccgttcagcttgtaaatggtcttgctcttggtctccaggatgattttggtatctcggttgatgtaggttatctccttcacttttattttcagtgcaaaatcatttttacaaagcgtttccattatgtcgttgtcatcatcatttttatttttgcaggcttcacatacctttggagcttcctcggtggctggcaggaggtggtcgctgctagcgagggggatgcaaaggtcgttgtcctgggggaaacggtcgcactcaagcatgtcgggccaggggaagccgaaggcggacatgaccggggcgcagcggtccttcacctgcacgcagagcgagtggcatggctggatggtctcgtctaggtcatcgaggcagacgggggcgaagagcgagcacaggaacttcttggtgtccgggtggcactgcttcatgaccagcgggatccaagcgccggcctgctccagcacctccttcatggtctcgtggcccagcaggttgggcagccgcatgttctggtattcgatgccgt

SEQ ID NO: 2671 - DNA, 334 bp, Homo sapiens
tataaactttattattttacattcaagtgaaacttccatctggaggggctaaacacagctgccggccacattcactgatttattactttgttgcctttttcgttcacctgatggaagaattcaaccctcttaaaaacataacaacaacaaaaacagctggagagtcccagccgtaatactaggtgtagacacgcacaagcacacacacaaattcaaaaacttctacatagaaaattaaaggataaacattatccatctattttgtactgtgtaatgcaacttttatatacataaatttttttttttttactgttttcagtcactgcaatttttc

SEQ ID NO: 2672 - DNA, 469 bp, Homo sapiens
gatttgggttggtttttatctctgattcttcccagtaactcatccactaagaaccctgcccacaggagggtctgatccaacggggggtttgaggccactcagctcagcctggttcccagggccagtgtcccactccagaggccaagtccatgctcccctcccctcagcaggcctgttcctccagagctgtccagtctctctgccaggctccaaattctccatcttcagtgtattgaccaaacaatgagacaggaggacagctgggagagcgggagtctgaaatcactggtagagtggcccaggacacacacaggagagagtctccaccgctgctgagatgaagggactctccattcttctcaaaaggcttgctgtgtttttggcattcccccacctgactttttttcaagtgagttgttccgatctgacctcagagaaggccaaactgggtgcatggtcatgtaggtgg

SEQ ID NO: 2673 - DNA, 459 bp, Homo sapiens
catgtaccagatttttaatgcatttgaatctttattctacaacacaagcaacataaatacaatatcttttaaaatattttctctttagaattttcatttccacctcagataaaatgtacacaaaatacacttgcaagcttgcttacagagacctgttaaacaaagaacagacagattctataaaatcagttatatcaacatataaaggagtgtgattttcagtttgtttttttaagtaaatatgaccaaactgactaaataagaaggcaaaacaaaaaattatgcttccttgacaaggcctttggagtaaacaaaatgcttcaaggctcctggtgaatggggttgcaaggatgaattttgcattttataggtacaatggtatactgactcaaatcattatggctataacaagcttcatttatttataatctttcaatgaattaaggttgattctttggc

SEQ ID NO: 2674 - DNA, 604 bp, Homo sapiens
tttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccgacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcagctgtggtctcctctgcaaagcattttaattaaaaacctcaataaagatggccctgcccacac

SEQ ID NO: 2675 - DNA, 420 bp, Homo sapiens
aggattatgttaatactaatctattcaccagataattaggatagcatatgtcaattacctggtgaatagattagtattaacataatccttcaaaatcaaaacaactacttgtcaaaagcagagcagataaaatcttacgtgtactccggtgcagaaatcggtgcctggaaccttgaaattttatttcttggggcagaatctgatctgtgccaccttaaataataattatgcttcttttacatattcagcttttataacacaaagaaaaagctagatctgattttactgtttagaattcacttttgcgctaatagctgaccacaatcttattgcctcttcgaagtaattaagaaaacaaaggctagtgctcctgctctcatacccgttcgcacttttattcttaaagccatggaataaaat

SEQ ID NO: 2676 - DNA, 450 bp, Homo sapiens
acagagtcttgaggaaatacatttctaagaaggatttttacagacactcatctttcatacccaaccacagggtctaactctaaagaggataaaaccaattactttcgtcccaagagctcatgactaatgacagcgtaaatctatgctatcaaaacctgcgtctctcatctgttacgagtattcaggcaggattcaaatattctcaaagaaagaaacacagtgcatgctgtgatcgcctgctcagcaacaacaagcactgcatcccaaactatctcctcccaggaattaaatgaggccagttgtgtacactggcatttcctccactgtggtactgcagaaggtctcagtgtcacaaagaatccttttgtcttctttaatatttatggtcacagctgtcttcccaagttgaccccgactgccagttcaacaagtcagtagcagtcaaaatat

SEQ ID NO: 2677 - DNA, 368 bp, Homo sapiens
cgactcactatagggcaaaacttttttttttttttttttgcccagccagaaaatctttaattgacaaatatttaagggacaagagggttttaagaaattaaaaggatgtatgaagtgaagtgagttgtgaacagaacctgggtgccctcctcatccacgtgcctcagtcgccctcgtgcctgaccggctttgccaatggagcctggaccctcagcacgggtcagctgtgggtgcgaacatggtggtctgggtcaggcctctttcaagtccccacaacaggcctgacttgtgcgtgagacgctttcaccttaaaccccacgccatcctgggggttcatggtcaggtataaaaccctgcagagaagtcag

SEQ ID NO: 2678 - DNA, 359 bp, Homo sapiens
tcaaaaagctttatttccatttggtccaaggcttgttaggatcacagatgagaggcagactgagattcaagcttgggtgacctgcctcaaatgcttaggttctttttgccaccacgagcttctcctggggtagggcttgggggtggcccatggtgctaatgcatgtggggtgctgaccggctttccctctgggagtccaggtggcgcatattagcagaggggccagggactccttggatccagggcgtgtccttagggtctcagccttgagggtgtaaaagctaaagtgagtgtccgggtggataagggacttggataggatcctgccgtgtgggctggggtgggtacagcaagatgcc

SEQ ID NO: 2679 - DNA, 713 bp, Homo sapiens
gtgaaaagtctcacccaggaggaacagccctccttgaagcaatggcagggcagcagggaggtgggcatggcagggaatggagagagtgagccagacagacttcacctccttactggacacagggtcactggcgagtttcaattgctgctccctttactttctctacctgtgactactccctggaccaatcctgaggagggcacaatttccagaagccacgtgataggggctggtttctgtggagccagaggatgagacactgaacttgagctcacctcctaacaccggcagtaaacttcctggaactttgccctcaggtgcggaggggacagaggaccctggcactctgttagggtgctgtagaagactagattgatggtagtttggcctgttagttcctgttttggccatgacttttgcagatggcaagtcacacaccctcaaagggaagctacacgggccaaatcgggggagtgggtggggaattttctcctctccctttcctactataatagtatttaagacatatcagctccagagatgagtcctggagccttgaattttgtttaacaaaataattgtaggtttctctctgtaataacaacgctggaaaggcagagaacctcttttatgctcatgtcttgcatttattgagatgactgtttctcatgcctttatgttccttcatgtaagtaaagtggacctttgtgctc

SEQ ID NO: 2680 - DNA, 760 bp, Homo sapiens
ttaaatgaagcaacatagtgagacgtcgtctctacaaaaaaaaaaagaaaaaaaaaattagccaggcatgcgaaacgctgaggtgggaggatcagatgagcttgggaggttgaggctgcagtgagccttggtcatgccactactgtgttctagtctgggcaacagagtgagaccttctctcaaaaaaaaaacccaaaattgtagaattacttctatagctatattttatgataaagaagtgattgtttctcaaaatcgcattttaaagacgttttatggtacttgttggaattgggacttaggagttttgattttgataagaaactgggataattttctgaactttttttcctctgtatcacatttatttactatttttaaaaactttgacatttaacacttgggacaacatttattataaatgataagaaaaatcttagaggtttgtctacccacagtgtcatggaatcttctttgaaaactaatccataaagtccctggagaaattggtcagaatgatctgtcagaaccatttgaaaacttgctcaagagcagttgcttatatatagtaggattttactttttcctgcttatgtactactatatgcttaaaaaacctggaggaatacttaccaaagaggagtaaccatctctgagggtgggattctgggggaatttttgtttttttctgttttctataatgtgaaacttttgtagtatgtatttttctaattgaagagaataaagattaaaacaagta

SEQ ID NO: 2681 - DNA, 508 bp, Homo sapiens
gactcataaagtgctctttattggcatctgaaaaagaagtgcctcagccttcaaggctgggacagaagttggggaggagctgctctgccccaggctcaataccaatagaccttcttgtatttccgggtctccttgatccccatggcctccatcacctcctcctgcagtgtctttagacagggcacataggttctttctaaagcatcttccactgatgtgtctttggggccatcaatccacgtttcagggacgatgccatcagctctgggaaattcgggtttagggataattctccctgatcgtgtggagactcgtacccgctctcctgcttcagtaaatctccactcgatctcagtgggtttcctgtccataggatccacaagtttgacctggcggtggagcaagggggcttcactagggatcatggttccccggtaatccatggtcttgccaatgtagcggtaatgtgtgttcagccctcccacgaccacccagtttcgctgccgga

SEQ ID NO: 2682 - DNA, 736 bp, Homo sapiens
aagggagaacagttttattagcatcacagggtccatttttccctttccatccaagcatccagagtctggtgtcctttaatcagttggcaggttcaacctggaggccactggagctgccggcccccaagtacatgaatgtgcagatgatacacagattgtgcacccagcttcccatcgttgatcactgaaattgagcttggggttagggagtcaggatcatggcagaggtcgaagaatgaagatcatattgagaagtaggaatgagaattcataggtgagggaccaagggccaaaagtcactcaccaagtcggtatccatctcccaggccctcagcctttgctgtctgcttggccacaaggagtaggtgtcctagaagctgctggtcttcttcttcagcctggctaatccgaggaatgggcttcttaggaatgaccaggaagtgcacaggagcctgaggggccacatcacggaacacaagacactgctggtcctcatagagaatgtcagctgggaggctcttgtccaggatccgggagaagatggttggggctgctcccccaggagttgcctgctgcgccttggccacttcattcccatcagtcacacctgcagctcctcggacctgccccccgcgcacccccgtggccgccacggctctgcgccgcgcgcaacccagcagccagcaccaccgtgccgccatcttccctgagccgcgggaacctctcacccgggtca

SEQ ID NO: 2683 - DNA, 708 bp, Homo sapiens
cagtgtacagatacgtttattgacaaataaagtacatgtacccctacacaagtatcactgcgacatttcaggaaccttggagctgggaacgccccttcctccctgcccgcctcttctctagcctcctcctgattgggcttgggctctctagaaaagtgcttctggcattgtctcgctggaaactctgtaggtgtgctggttgggctctcagtgtttatcatgtccacacccttctgtccctgggagctgtggacaaggggcgatgagcctgctcagtcattcatgtccagcccaaactctggatacaactctttggtggtgacacctcggatcacagctagtttgcccatcagcatctgccccacatccttgatgtcattgtactcgtgaagctgggtaatgtggtcctccagttcatccacactgtagccttcagatacgaactgggagatctccttgtccagcatgtccctcttctccttcagtttctgaatgtcaaggtgcagagactcctcgctggtcccatcagcctggccagacttgggcaatggcctaggggatcggaaggccccgcggcaacttcgggtaagtcttggttcagtcctcctgagccctgggtccgaggcccccggatcagggggttcaatggcgcaagagggtccagcgcgggagtcggagagcgacctctcaggtgcaccgggccaggaa

SEQ ID NO: 2684 - DNA, 449 bp, Homo sapiens
ctatcccattttttcatttatttttatgaggagcctcaaaaaatagaagtggccttggtagggaaggaatgtcgtgattctgagtacagtatggcaaattcttttgcctcagtttccctaactccatccagtgcatatgaaaatgtctatgtgcgtacaaggtaggtctggactaagctctggccctccggttgttttcccattgcgggagcctaagccagggtgcccaggactcctgtgtggctggtgggcctgatgcccacagctgatgattcaggaaggaggggcctggagtctgctgcagactctcccgccccctacagcccaaaccgggcactgcagcaatgaggtggtcagtccagggagaggtccgacaagttctcggcacaatgctgcaggaagtcaaagtcaggcacggagaagggcacgcgggaccactttttggcctg

SEQ ID NO: 2685 - DNA, 610 bp, Homo sapiens
aaattaaataaacttttattttggaatgatactagatttacagagaagttgcagagatagtacaaagagttcctgtatacccttcacccagcctaccccaaggtcaacatcttacatcaccatggtacatctgtcaaaaccaagagactgaaattggtatattaactaaaattcagacttttttcagatttccaattttcccactaatgtcctgtttttgttccaagacccaatccaggatgccacattgcactgaagacactctcccttttcaattctattactggtcacctcagtcaactttcccggggaaagagaatgcatgggaaaagctcttgtccttattattgaactggagaaactgaggcttaaaagtgccgagtgaccaagttcccttagagggcagtgagaacaaggcctgccttactctgttccctttccccagggactcttggttttcagaagcccctctggaatgtcctacctggcctaaccccataccagcagtgcagacaaggaggcactcctactacagtgggtccagcccatggagagactcacttcctgccccaacacctcttcccctagaccctgagggccaggacaatgt

SEQ ID NO: 2686 - DNA, 859 bp, Homo sapiens
tttttttttttttttttttgagttgctgaaaagtttacttttgagttttaaactgtactttgaaaactatattgtgaactgtgttgacatgaggaaaggctgggctccctgaaaacatccagttccacagcagggcgtgcccaagcccagccaatccccaggcaatgcagggcagggatcccacctggtataagtacgggcagagggcagagcagggctgtatcgaggggcggcgctgggaccctcctcgcccagagttcctactcatccccagcacagaagtgctctgtagggccagctgaggacaccccggttcactgagggtggcccacagtaagtcgccgtctggcagtaagttagctctggcaggtgtggacccaagaccacacacagcctttctcaggtgcaggtcctccaagcctcacttcgcagtggtgacaggcaacccgtcagggcagggagcttccaaaggccagtccgagtccatgccaggcgtccactaaatctgcctctccctctccagcgagcaggtgcagccctcaactcctgcaggcctggggagcggagacagggcctgtaggctcggacacgacccggtcctgattttaacagtagacttgagaaggcaggctcagcagacaggctgctggaggatccacccgctgtctcccgcagcggccccactgaagcggcagaaacacacagaagcaccaaatctgtcactctcttcccgtaggaagtccccagaggtggccctccggaggatggtcctgttggctgaagatatgaccacacctgtgcctgcccagggccaccttcagcttggcaacaggaactccgcacactggtaccctgcgac

SEQ ID NO: 2687 - DNA, 541 bp, Homo sapiens
aatgtctcacgaaggtttatttgaatagagttacatctagagttctcatttcagtgtacaaacaactcagtgcagtgtttctaatacaagtcatataaaactggaacacactaaatgaatagtgcacttgatagaaaaataaattacactttaaatgctactgcaaagttttacacatataaaaggtaaacacaaaatagttagtgagaccctcataaccacttatcatatccagataaggagataaaaggggcaaaggaatctgtgctataaaaaaaaatctctctgaagaggagaaatcctgacaagtaactgaatgatcatctcaagcaatgtggtgacatagggacttacagatcgtatctcttagaactgggaaggaatcatagctctaccaatgtgttaacacaacccagttcagctcagggcaaatttctataattcaaacaaatgtcctcatactaacgcctaatatgtaggaaaagtttccaactttcttctgaccactgaagaggtacagtgtttaaatttttgagaggat

SEQ ID NO: 2688 - DNA, 351 bp, Homo sapiens
gggcagacagaaggctttgttactgccaccgggcaggagacacagggtcagggttccagggccaagttatccactcccttgggtctttccttcctggggctttccctgcggggcccgggggagctgcagcagcagcagtgggcgacgaccagcagcagcaggagcagcacggtgcccatgaaggtgaggaaaacaatgaaggcaacagtgtcccatgtggactggaaaaactggtggctcttcagtctccccaggacttcctgaaccgtggcctccagctcctctgtggacacagccatcttggcgtgcaccgtgccacctcctagaagcctccaattcccccaaccaggc

SEQ ID NO: 2689 - DNA, 646 bp, Homo sapiens
gcaagttcctgggtttcacattcatttctgctgcatctagtagctccacacatttcataacctgatctctttatttgtatgcaaaaaatactgtcttaatacagagcagcatttttgtaacaaagagactcgctggagctatttggtgcttgaatgtgaccatcctttttacttttgctaagccttatttaaattttgtataccgtggaatatgtagaatttgtcaaatcattttagtgctgaaggtttttgatttcttgtttttgtttctgttgttgcagtttctttggtggcttgttttgtattgtaagatggcacttgctgatataaatactaaggcactaagagaaaatacagataagtatttataagttgcttgggaaccatagcagaattttttgtttggttttgtaagagaaaaaaaattaccaataaataactgatctagcacccaaactctcttgggggatgtcttagtatcttcacgctataaaattgttcatctaagcacagcatcatcttatggccttatggattgtaaatcttctagtgaggctataaactccactctgaaaacaaaggcataacttaaccgactgctcagttgtccttcgttgtaaaatgaattggctttgggaaaaaggaa

SEQ ID NO: 2690 - DNA, 632 bp, Homo sapiens
aagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagccataataaacttgtaaaattaag

SEQ ID NO: 2691 - DNA, 938 bp, Homo sapiens
ttttttttttttttttttattgttttaaaattttatttataaataaaagatatatacatatgtgctttaatatgattaacaggttccattttgtacaaaatgttaaacctagagtcctctgcgtcctggatgaggcgtccaaagggtggaatagtacagcattaggacctttgttctcctcttggcttctggaagagaaactcttgcatgccctcgactttcaccgcaaaaataagtgagaaaaaagataaatcccatttatgcaatgatatgtagctatgagttaatcacggtatttcattccatgaaatccattaagctgctggcatttgcatggctctaagtttattttaagaggctcattcaaacatggccaggaatatattggcctcttgagagtttgcatggcaaggagttatacagcaggaaaaagaaaaaaaacccaataattatattgatgcaagattcatcagtattttagaatattgtcgtttcaacatgttaaattgtttctgagcactgctgatttcagcactgtccctggtccacgtgacgcaaatgccaccctttccatatattcttcagcaaaaatatatgaaaagcccgtcactccctaagaggaccctgatccctctggagaggaaaactaaactctttaagaagaaaaccaaacccaacctgaactaatcgtccaaggagtcctgtttggtcccacgaaaggcagatttccatccacaccagtgaggggcaagtgtccgggttccaactcgaagccaggcgggcctgtgcgggggtgagtcctttgccacccggcgccccccaggctctacaagcgtctagaggtcggagtcgcagggcagcgagtgtcgcaggggtgggtgctgcacgagggagcgtcctgggactcccacccctcccgtcgaggacgtccaccgagt

SEQ ID NO: 2692 - DNA, 726 bp, Homo sapiens
taggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagccaaaaaaaaaaaaa

SEQ ID NO: 2693 - DNA, 805 bp, Homo sapiens
agattagtgcagcccggagcttgagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaa

SEQ ID NO: 2694 - DNA, 718 bp, Homo sapiens
cacaggtttgtcttttaatcagcatccatgaaaattcattaaaaggtctgatacgaaaagcaccaggctaacaaatcagtcctgaattcaattttacaaaaacaccctctcctcttccatctcatccctaatattcctacgttatctcgaggtgcagagaaatataaaagggatccttgacataaaaacgtattaaaaagccaccatgagtagaatgtacggtaacagcgtctgactcggccggcaggacaggaaacctacagaaccaccatgccagggctttgtgtgagcaggcgggcactccacatgggcacgtgtgtgagcaggcaggcactccacatgggcacgtgtgagcaggcgggcactccacatgggcacgtgtgtgagcaggcgggcactccacatcggcacatgtgagcaggtgggcactccacatgggcacatgagcaggtgggcactccacatggacatgtgtgtgagcaggcgggcactccgcatcgacatgtgtgagcaggtgggcactccacatgggcacatgagcaggcgggcactccacatgggcacgtgtgagcaggcgggcactccacattggcacaaagcgagggctcatgcataagaggtgcagggacacctggacagctatttgaaatttaaaaactgggtttcctggctcacattttgtatcaaaaactagaagtagatcaatgatttcaatatg

SEQ ID NO: 2695 - DNA, 696 bp, Homo sapiens
ctgtaatgttattgcagatccacatctctcgctcaactgttaatgtctcaacctccagaggcaccccacccagcacactgtcagtaaaggggcagattgaaacagtgagagttaagggtacagtagaaaattctgcatgtttgcagtgactagaatcagatagtagtgtggtggtttttttttttaatcattatgaagagtgggagcttgcaggtaaggcttctgtggtggtttgaaaagcagaaagcaataaatgaaacaaagtgtttgtgtaatatattcctgccttgtcttcttcactcagagttgaaataggttttgcagtaaagctggaaaaaaaaaagaaaacaaatgttcaaaactgtgtgtgttggtgggtggaatttcctttgcttatagtagtttcagtagtaactatatgtttttttttcctttctttttcacaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctcaagtaaaataaatatcagttaaatattgg

SEQ ID NO: 2696 - DNA, 501 bp, Homo sapiens
tcaaatgtatcagtttattaaaaatgcagcatttttcacatgagctttaaagatgtggaagatggggtacaattaaaaccatgagagttgtgcagggaacagccgtagggcctgtttgcaccttcagatattgcctgctcccaaaaattcagacccccagatgcagggcaagacaataagaaagggtgagtgcaagcaaggagagcctcctgctaagaggctgaggtcccctctggttccaaggatgggatgtcagccttgaccttccggggtctgcagtggccagaggctgcctgtcgccccttcctcctccccttcttgggcactgtgggagcttctgggtcctgctggaggctggtcccctcaggccgctgggttgcagtcctcttaggaaggtctctctttgcccttcgtgtcctggaaggggccttgcttggaggcaaagcgtcctccactctgtcctcaggactcagctgtgtggccttggatttctttttgcgg

SEQ ID NO: 2697 - DNA, 447 bp, Homo sapiens
cacaccgctaagggctttatttcacagatcatggtggtgagtttggatttccagccctcaccacggttaagtcacacatttcccgacacctgctcatttctccagatctgaaacatctcacccaacacatcctagttgttgtaaaccccaaatgaactttccagaagcaaaaacaataacagattcagagaaccctggtcacacctgctgagcaggtcccctctactctggttgcatatagaatgcttgtttgctcaaaagagaggcgctctcaacatcaaggcacaaagaaagacgtctccaggggcaaaatgatgacgaagtgaccagcggcctctgcgaggcccgaggcagagtcacgggggaggcgagttcagcctgacgggcattgggaggaagagccaaggacaggtctcccgctggggctcaggcgtcctcacgcgtact

SEQ ID NO: 2698 - DNA, 956 bp, Homo sapiens
gaggagatggcacagaataagcaatttattgcaattgaattatccaatgtggttgactgaatataaatatttttattacaaaatattccaggtaaaaattcggagctgcttacaagcttctttagctttaagctcattgcatttcttcatgtctagagcatgggtgacgggctcaggtgtgcctggcctgccccgcagggtcctccttctccgtctgcagtgggtcccactcagtgaggacctctgaggacacctcagtgaacagatggtcccagtcccagccgacatcatcctgccaagaagggtttcgctgggtaagacaaagaaaggccttttccctcaactgtagctgacttctccctcccatccaggcctcagggaggcacaggccagcccgggagtcggctggttatgggaatgccagagctgagagaccggggaattgctgccaccactgtacctcccggacttcgtgctccggcgcgagcactttggtgaggagtttcaggtcgatctccccatccagtgtctgaatggctgagtacttcatgaggtcattgtccaggtcacggtaggtcatcacccgctttatctggatgctgggaggggctgccacctgcaaaacaaagtcttcttcctgtacttcctccagatccggaatgataggaatatctcctccataatctgatccattcaggctctgtggtctgaggcggaaatcttctatttcttcagaagccttcctcctaaacttcgaagccttcacggaatcacctgcccagcctcctgtcggcagcgaggtaatttagcagaggaagtctctccagtcagagtcaaagaggaattcttgccattgaggtgattctcggcctgcgctgactcctgttgagctcggcgacccatcttggccctggaggtagccaagctgtagcgaagctcctcgtccaagtcgagca

SEQ ID NO: 2699 - DNA, 377 bp, Homo sapiens
gatttaaaaaagatttatttacttgttgaatatttattagtagtagtagtaataaatataaccccgaagccacaaataaccttaggattctctcagctttaatggcagtagagtccagcttcttaatcttttgcacaaaatacactcaaggaggagctatccataagactaatagaagacttttgtctccctgacccagctcctctaatttcatatgggaaacacctaacagccataaagtgatgatctgggagtcctcattagagatgggctggacatgtcagaaagctgaagaaagaaatcaacctatttgtgaaccttaccatctaaaattgttagtctgtgtcttctaaataaacagagacctttttctcttg
